United States Patent 9,567,581 (SELECTIVE REACTIVATION OF GENES ON THE INACTIVE X CHROMOSOME) - sequence listing, part 26

SEQ ID NO: 3368 - DNA, 63391 bp, human
gattatgggacagctctcagataaattttactacacagattgtctcttttttggagcaatcatctctgccactgacccaggtatttggctttgtgtatttgtctttattattatgatattccattatttaaatctttaaaagttcagagcaatcattaacttttgttgcagtagggagaatgtagtatttatttgcatggcatggtggtggaagaagtgaccaataggtgggtctaacagacttagatggcttttcttttcctttttccttttttgagacaggatctcactctgttgcccaagctagagtgcagtggtgcagtcacagctcactgcagccttgacctcctgggctcaagcaatcctcctgcctcagcctcccaagcagcgggactacagttagatggcttttctaagaagggcatgcaatttccttttttattattaatttttttttattgttgtaaaaatgcctgacataaaatttactatcttaacaattcctttttttttttttttgagacagagtcttgctctgttgtccaggctggagtgcagtgacacgatctcggctcactgcagactctacctcccatgttcacgccattctcctgcctcagcgtcctgagtagctgggactacaggcgcctgccaccacgcctggctaatttttttgtatttttagtagagacagggtttcaccgtgttagccaggatggtctcgatctcctgacttcgtgatccacccgccttggcctcccaaagtgctgggattacaggtgtgagccaccgtgcccagcctatcttaacaatttctaagtgtatagttcagtagagttaagtatacccacatcattgtgaaaccaatccccagaaccttttcatcttgcaaaattgaaatgctatacccattaaacaacaacttcccagtcccccttccctgcagcccctggcagctacctttgactttctgtctctatgaacttgactactgtagatacttcatacaaatgaaatcatacagtatttgtccttttgtgactggcttatttcacttagcataatgtcctcaaagttcatccattttatagcatttctcataatttcctaacctttaaggctgaataatattccattgtatctgtatagcatgttttttttttgttttgttttgtttttgagatggagtttcactcttgttgcccaggctggagtgcaatggcacaatcttggctcaccgtaacctctgcctccgcctctgcctcctctgcctcagcctccggagtacctgggattataggcatgcaccaccatgcccggctaatttttttgtatttttagtagagacagggtttctccatgttggtcagtctggtctcaaactcccaacctcaggtgatccgcccacctcggcctcccaaagtgctggaattacaggcgtgagccaccgtgcccggctgtataacatgttttgcctttcgtcttagaatgactaatttggtcataagttttacacttagattttcttctttcccagtgttgcccttttgccttcttttatgtaacatagcatttgggttaaataataccttttcttagtagaaacacacatgattatctgtagtgaatgtaatttaatttgtaaactccttttgtgcggcattcctgcaggactgtgcactgtgacatggttttctattcatcaatcccttgccttgtatttttcaagtgttggttgaaccaattcttacaagtgaattattacaccctcccttgcagctcaaaacaaacaaaaaagttctcctttccaagttgaaacctataatttgatcagtttgcataaagtagttacagctattctcttccttagtgtcatctattgagagtacaccttagggaaagaagttctggagaatgagctgctcctgtcctcacggtagagatagaaaggtctgctcaatgtctccaatgccctctaatattctgaacagtaataaccttaaagatattaagataccccacttgaccatgccccttgggggtcctctccatcagtgctatctttctgtgaagatagagatgttctataatctgcaagtccattgtggtaaccagtagccacatgtggcttttgagcacttgaaatgtagggtaatgcaatagggggactgattttaacttttatttaatgttaagtaatttaaatgtatatagccacatgtggctaatggttaccacatcaaacagcatagctctagacagttgtgtggttctgaagaatctcaatgttcaaaaaaaaaaacattgacctctcttaccctcatattttattacaaacaccctgagtaaattagtattgaagacttggctgtcgaggcactctggtttgtgaaaaggtgggatttggagtcacaggccttgggtttagttctagccctaccaatcactgatcgggtggcctgggcacacattgtcccctcacatcagtttcctcatatataaagtagaaatgatggcacctatctcctaaggctattgtgaagatgaaatgaaacaacacgtgtaaggcactgagtgtaccctgtctaaattatgctggtctgtgtccacatctgactcaggcagagatttctcagttttccttatgtttaaaaaataaacaaataacagatcatctctgaagccaagcatgtttccaaagagaactctgaaaatcagctttattattttaatcctgtgctgtctgtgactgtctccagatgtgtgtctgtggagaaatagatcttcataagtctgagaaaggtatttagtctgtccgaaaatgtgtttctaagtatactcatctataattttattactgacatcttactagtaccactaacaagtaaagggaagttagtttaacataaagattattgatattgtttcctgagctatcagtgttacttcatttaattggatagagaggcttacttttctagattatctttgtaattgtttacttccctttaatgtgtctatgctatggtagagaataatggaaggcattaccatgctactccattttcatttggcctatgaagactggcacagtaagggctttatagaaatggaagttgtagaaaattgaaagtttaaacttattaagcatcaggacattaactttaactgctttttaaatagaaatattcctgaaatgtagaatgtttttgtaaattagaagtgttttaccagcctcctaaaaaatctgttgtttgaaaacttgggtcataaaagagataaaatcttaagtgcagagttaagcatcacaagaccagattgacttctagtacctggtgcatcaaacaaaaattctgatattggcagcctgggcaacatagtagaacttcatccccacaaaaaaattgtaaaaattagctgaccatagtggtgattgcctatagttccagctactcggggggctgaggcaagacgattgcttgagcccaggagtttgaggctgcagtgagctgtgatagcaccactgcactccagcctggatgacagagcaagaccctgtctttaaaaaatgaaacaaaaaactttatagtgttaggatacagagtggtattgactgatatgaaggaataagaatccttgtccctgattactgtacttggcttgagacatgagtctttggtcttctggtcaaaggtgacataatatatgtgggatagtgtaggctgcactgtgacagggagccttctccactctgtggtcatgtgtcatggctgccatgtgccatctttgtgggcttttgttttagacggatccacaattaaagaaaaaaaaatgcatttgcaccccatggtgccttcctaggcagccaccagagaacacatgccactgcactccagcctaggcgacagagaccctgtctaaaaagaaaagaaaaatagaaacctgtgagtcaggctgattgactcaaggagtacaaaggtgatgaattaaaattggggaaatgacatcatgatggttcacaggaagggcatgcaatttccttttttattattaattttttattgtggtaaaaatgcctgacataaaatttactatcttaacaatttcttttttttttttttttttttttgagatggagtcttactctgtcgcccaggctggagtgcatcctttgggacttggttcaaatgtgccacctgcctagtcactctttctagactccattatctgctccctcagctctttgagttaggtctgttttgtacatgtcagtgcttgccactttgtactgagtgctcacaagtgctaagtgcccttgactacatggatgatgtgtccaagaaaagttagttgaatgaacacatttaggtccttgagtttttccttcttcatatatctgccattcttttgtttttcccactgcctgtacccagtgatctttagttagttaattgtgatttctcagtctgtgttcagttggaaatagctgtgaccctgctcaccctgatttcaagggtcctgctgtagggaggagggcagtttgtttcatctctcccattaaagaccacttagccagtctgtcatccccatcccatcgtcttccagttgtcagcacccacatcccacccccgtggtcaggcacagacttgctcaggaggggcacagaacggttcctgacctgttttgtgagataatgagcagggagaatgagaagttgaaacagatcagtgctatgtacgtgtttattgttattattattaattatgcttttaggccaggtgtggtatgcttctgtggtcccatctacttgggaggctgagatggggggaattgcttaagcccaggagttccaggctatagtgaactataatcacaccactgtaccccagcctgggcaacagagcaagaccctgtctcaaaaaatatatagaaataaaaataaaaataaaatttttaaaaaatgggcaaaaccaaatgatagtgtcagggaatgtgcatttgtgtgattaaattatagggaaaggcaagaaaatgatgactataaaatttagtttagcggttccctttagtgaaggaagaggcttcagactgggatgggacatataggggactgacaaagttctatttcttgaacaggggtgtggttacaagactggttggcttataataactcactaaactgaacatttgtttggcttggttttctaattgtatcaattagtaatgcttttggctgcaaagaacagaaaaacctggctaatccctgcttaaacaaatagatatttatcttgggtaccagtactgggctgatgtcccggcttccactacaatcataaaaaatactacactcagtctttctgctccactgttctggggtttcagtcacacatcagttgccccatggaggcaagatgactgcgttggtgtctggcctctctgccctcttcctgacaggaagaggtaatgctttctgcaagggaagctgggaaagtgggtttttagtttttgcagttgtatggtagaaaccatcaagagagagggtagttgggtatgagtgttgagagagaacacagctctcgtgcatgtatctagatcggtggttctcagtcaggggcgatattgcccctgcccccacccccgtcattattattttaagcaacacacacaccatgtttcaaaggcttggcacaaagatggaatttataaaatctaattaatcttttttttgagacagagtttcactcttgttgcccaggctggagtgcaatggcgcaatctcggctcaccgcaacctttgcctcccaggctcaagcaattctcccacctcagcctctggagtagctgggattacaggcgcctgccaccacacccggctaattttgtatttttagtagagatggagtttctccatgttggtctggctggtctcgaactcccaacctcagggatctacccgcctcagcctcccaaagtgctgggattacaggcgtgagccaccgcacctggccctttttttttctttctttccttttttttttttttttttttgagatggagtttcactcttgttgcccaggctggagtgcaatggcacgatcttggctcactgcaacctctgcctcctgggttcaagtgattctcctgcctcagcctcccaagtagctgggattacaggcatatgctaccatgaccagctaattttgtatttttagtagagacggggcttcactgtgttggtcaggcttgtgtcgaactcctgacctcaggtgatccacccgcctcggcctcccaaagtgctgggattacaggcgtaagccaccacgcctggcccttttttttttctttctgtttttgagacagagtttcactcttgttgcccaggctggagtgcaatggcgtgatcttggctcactgcaacctccgcctcctgggttcaagtgattctcctgcctcagcctctcaagtagctgggattacaggcgtgtgccaccatgcctggctaattttgcatttttagtagagacggggtttcaccatgttggtcaggctggtctcaaactcctcacctcaggtgatccacctgcctcagcctcccaaagtgctggaattacaagcatgagccaccatgcccgaccaaaatctcattaatcatttttataataactttgttattttaaccttggctctattgagccagagaaatcaaagagatttcaacccactggtgaagccaaatcacattgattgtcattattttttgaagttctgtaacagatactttcaaagtgtgatgggatcacagtggaaagcatagtgttttggtgcaatatcattagactcaagcatcatatcaaagctccttcagataaggaagattgcggttttcatttctgccacagatagataagtctatctttgactcccttgctatctcttgaatcacccagtcccacccaagataggaattgcctctataaatctgtaatcagtgatttaaggtcagaaaccaaaactaatttctgtgctttcggctcacttttcagtgactgtgctggcgatatttaatgaattgcatgcagacgtggatctttacgcacttctttttggagagagcgtcctaaatgatgctgttgccattgtactgtcctcgtaagtagcagtgtttctgctggagaagagacaccccagtttcctctatgctttgggctaaattcagaggcttatcttaaatgtattacatattgaattgggtgtttttctaaatgagatttatcagctttgtggataaaattacgttgctttgtgtgcccagcagcaatcagaatgctgacaccagcgtaacatggtggctgcagattaaattaaatgaatttaccctgggcaatgctggctgcagattaaattaaatgaatttaccctggccaatgcttgacaaaatgtagatagacctatgtttgtcgatattttcaagtaccatagtgtaaaacctgtgcagtcttttaaaactgtctcttgtttttaaactttaggtctattgttgcctaccagccagcgggactgaacactcacgcctttgatgctgctgccttttttaagtcagttggcatttttctaggtatatttagtggctcttttaccatgggagctgtgactggtgttgtgactgctctaatatcctttttgtagtttcagctcgggcctgggtatgcgtgtgtggcattacactttcaaaaagaaagttctcagctgttctttcaaattggaattttacattgagtgttccactggggcatgatggctcctgaaatatgtcactttggtgaagcatgacggttgggtccctagctgagagtctgagaaaatgtttaggaatgcaaccctagacttcgctctgtcttcacctttgctgtttctctccctttcttgtgatccagttggagcatcagttttagaggggtgaaaagagctgaggaggcaggaggagactgagaattagggactactggctgggaagtactttagccccagctagctgctgccaactgctgttcccggccacatggtgttatgtggcgatagctagttagtggccttccgtaagcaaaggatggcccagtattcagtttaaacaaactaaaaaaacagtgtggaaagagcaggcatcccttccacagatgtggtgagtcctgcatcatatcctctttggtgggcattactatgtaatttaaaccacatcattccaacatgtaatcaatatggaaaaaaataacaaaattatgataaaaataatttttttttctttttttttattattattatactttaagttttagggtacatgtgcacaatgtgcaggttagttacatatgtatacatgtgccatgctggtgcgctgcacccactaactcgtcatctagcattaggtatatctcccagtgctatccctccccccttcccccaccccacaacagtccccagagtgtgatgttccccttcctgtgtccatgtgttctcattgttcaattcccacctatgagtgagaatatgcagcgtttggttttttgttcttgcgatagtttactgagaatgatgatttccagtttcatccatgtccctacaaaggacatgaactcatcatttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccaataatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatggccattctaactggtgtgagatggtatctcattgtggttttgatttgcatttctctgatggccagtgatgatgagcattttttcatgtgttttttggctgcataaaagtcttcttttgagaagtgtctgttcatgtccttcacccactttttgatggggttgtttgtttttttcttgtaaatttgtttgagttcattgtagattctggctattagccctttgtcagatgagtaggttgtgaaaattttctcccattttgtaggttgcctgttcactctgatggtagtttcttttgctgtgcagaagctctttagtttaattagatcccatttgtcaattttggctttcgttgccattgcttttggtgttttagacatgaagtacttacccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctaggcagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtatcatgctgttttggttactgtagccttgtagtatagtttgaagtcaggtagcgtgatgcctccagctttgtttggcttaggattgacttggcgatgcaggctcttttttggttccgtatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattgcctgtgggtttgtcatagatagctgttattattttgagatacgtcccatcaatacctaatttattgagagtttttagcatgaaggttgttgagttttgtcaaaggccttttctgcatctattgagataatcatgtggtttttgtctttggttctgtttatatgctagattacatttattgatttgcgtatattgaaccagccttgcatcccagggatgaagcccacttgatcatggtggataagctttttgatgtgctgctggattcggtttgccagtattttgctgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaatttggctgtgaatccatctggtcctggactctttttgattggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtgtttctgtgggatcggtggtgatatcccctttatcattttttattgcgtctatttgattcttctctctttttttctttattagtcttgctagtggtttatcaattttgttgatcctttcaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttaatgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttattttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacaatggggtgttaagtctcccattattaatgtgtgggagtctaagtctctttgtaggtcactcaggacttgctttatgaatctgggtgcttctgtattgggtgcatatatatttaggatagttagctgttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagttgggtttcctgaatacagcacactgatgggtcttgactctttatccaatttgccagtctgtgtcttctaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagtggctggtaccggttgttcctttctatgtttagtgtttccttcaggagctcttttagggcaggcctgatggtgacaaaatctctcagcatttgcttgtctataaagtattttatttccccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagatgtagatttggtcttttcacataatcccatatttcttggaggctttgctcatttctttttattcttttttctctaaacttcctttctcgcttcatttcattcatttcatcttccatcactgataccctttcttccagttgatcgcatcagctcctgaggcttctgcattcttcacgtagttctcaagccttggttttcagctccatcagttcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctctgtccagctttgttccattgctggtgaggagctgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggccgtgtgaggtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcggaggttactgctgtctttttgtttgtctgtgccctgcccgcagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagactccatgggtgtacgtccctccaagccatgtgcgggatataatctcctggtgcgctgttttttaagcccatcggaaaagcgcagtattcgggtgggagtgacccgattttccaggtgccgtctgtcacccctttctttgactaggaaagggaactccctgaccccttgcgcttcccaagtgaggcagtgcctcgccctgcttcggctcgcacatggtgcgcgcacccactgacctgcacccaatgtctggcactccctagtgagatgaacccggtacctcagatggaaatgcagaaatcacccgtcttctgcgttgctcacgctgggagctgtagaccggagctgttcctatacggccatcttggctcttcccccaatcatgataaaaataattaatgagattttatacattcaatctttgttccaagcctttgaaatatggtatgtgtgctgggcgtggtggctcacacctgtaatcccagcactttggaaggccagggtgggcagatcacctgaggtcaggagtttgagaccagcttggccaacatcgtgaaaccctgtctctactaaaaatacaaaaattagccaggtgtggtggtgtgcacctgtaatccctgctaatcgggaggctgaggcaggagaatcacttgaacctgggaggtggagattgcagtgagccgaggccgtgccattgcactccagcttgggtgacagagcgaaatgccgtctcaaaaaaaaaaaaaaaaaaaagaaagaaagaaagaaagaaaaaaagaaatacagtgtgtgtgttgctcttacaacacatctcaatttggactagccacattgtaagtgttcagctaccacattggatagcgcagatttaaattgctttcttcacaagggcccttttgatgccttggagacgtatattgctcagtgagatctgtcatgagatgcttctatgctggccgtgtgttgaatggcactgttacaagaaggatctctggtcccgaaaggtgacaccagcacctggtagctgtctcaagaattatgcatttctttctttcctgtgccttccttaggcacctgttgtggactcaggtggcctcggtggtgcacaggggtcagggtctcacaggccttgtcttcacagccctgctggaaccaacccaacaagccagcctgacgtcatgaccatgcctctcagaaccatggccattcaaggagcacagaaaactagttgccagtttctctagaattctgaatttttaaaagaacagccttattgagatataatttatataccatacaagtcacccatttaaatttaatggcttttggtatattacatgataatttttttttttgacggagtctcactctgtcacccaggctggagtgcagtggtgcaatcttggctcactgcaacctctgcctgccgggttcaattgattctcaacctcctgaatagctgggattacagatgcgtgtgaccacacccggctaatttttgtatttttagtagagacagggtttcagtatgttggccaaactagttttgaactcctgacctcaggtgatccacctgcctcgggtcccaaagtgctaggattacaggcatgagtcaccacacctggcctacatgattaattttttaaaattgtggtaaaatatagccaacgagatttgtcatttaaccatctttacgtgcacaattccgcattcacaatgtcatgtagccatctccctgtctactttcagaattttttcatcatccgaaacagaagctctgtacccattaaacaatgtctccctgtttcttcctctctccagcccctacaaaacttgtgttccactggaaagcttaatttgtattacttaagaaatctccagcagctttagagcctccaaaaaaaaaaaaaggttgaagggaaaggctagccctttggggaggggtcctgggctagtggagtatggttcttggtggccctgatacatgtacctggagacagggtccttgacagaatgccaacgtgactaagtttaccaaactgcactgcttccccctgctggagacggcgctgttcttcctcatgtcctggagcacgtttctcttggcagaagcctgcggatttacaggtaggttttttctactcttggaccacccttcccctcactgtagtggggtctgtgggaacttgaaggaagggaagaattcttagataacagctgcacagagtttaactgttcagcaagtgtccgtatggaggattgctgagcaaggctattgttctgtcttaaatggattatttactttccaaaaagctagactttttttaattttatttttttagagacagggtcttgctgtgtcacccaggctggagtgcagcagcacaatcatagctcactgtaacctcgaactcctaggctcaagggatcttcccccttcaccctcccaagtagctaagactacaggcacgtaccacacccagctaacttctttattctttgtagagatggacaacatttgctatgttgtccaggctggtctcaaactcctgaccttaagtgaacctcctacctcagcctctcaaagcactgggattacaggcatgagccaccatgcccagcctgaaaaagtagattttaatgataaagtttatcattccaaagtcaattacatttttgagtactcattctaactgtaagtagatgttaaggtgcaaagaatctattaaaattttatttgtatatttcccttgattgctatgttattttgcaaacagtagcaataacaagcaaaatatgtgtcctttaaagggtgattttgcctctgctcagatgagtgtgaacacggtttttcattgttttgtttctgggctatttaatcattgcttttcaatatcacatttttatggtgtcagtttcatatagtattagtgaggtgaaacatgtggttttacttcctcacattctttcattttaaaaaaacattgaatttttccattagaaaattcaagtacagttctgtacataatccaggtacttaggatgtacttttgtcaccctttcaaaatactgtagcaaatctttatatgcagcattacaaaatgccccacttccttaaaatttaacagttatctgtaaatgtgtaggcaaagtcccaggtgtgtcatttgtctcgcacaacaaaatggttaccattaaccagaaatatagaagatcggggcttggataaatggaatagtactcttgatctattttgtctaaagccctagactgtgaaaaaatctaggccaggcacagtgcgcatgcctatataatcccagcactttggggccaaggcaggtggatcccttgagctcaggagttcaagaccagcctgggcaagatggagaaaccccatctctacaaaaaaatacaaaaattagctgggtgtggtggtgtgcatctgtagtcccagctattcaggaggctgaggtgggaggatcacttgagccttggagatagaggctgcagtgagccgagatcatgccactgccgtccactgagggatatataatatataatccactttgtctcaaaaaatatatatgtatataaagcattagtttgaaattcagttcattcattctaaaaacagtgaggaatatggcaaaaatttggatgggccctcacagtctctttgaaggaatgaatgctatatgccaactacagatggtagttggaggagtttagaggaggcaggagatacccttaaaactggaacaaggaggggatgttgaggtacttggctttgaaggaaggcagggttgggagacacaaaggttgagaggtgaggggttgtaggagtgttcagtagtaataggaaacttttttttcttttttttctttttctttttttttttttttcttttgagaaaaggttgccttctgtcgcccagactggagtgcagaggcgtgatcatggctcactgcagcctcgacctcccaggctcaagcgatcctctcacctcagcctccctagtagctgggccacaggcccacgccaccacatccggctaattttttgtatttttggtagagatggggttttaccatgtttcccaggctggtctcaaactcctgggttcaagcgatctgcttgccttggcctcctgcagtgctgggattacaggtgtgagccactgcgcccgacccagcaataggaaagtttcaaaaatattcaggaagttggatatgctaggcttgcctaccttaactttttgttctagcagggttttttttttcccctgcctcttttttttccattgattttttttggggggatgttttaacaggtgttgtagctgtccttttctgtggaatcacacaagctcattacacctacaacaatctgtcggtggaatcaagaagtcgaaccaagcaggtgagagagaggcttggtactcacgagttgcttgttaacacagggaagggggaactgcagggttacagcttccttttcccttctctgtgcagctctttgaggtgttacatttcctggcagagaacttcatcttctcctacatgggcctggcactgtttaccttccagaagcacgttttcagccccattttcatcatcggagcttttgtatccttttcttgttccaccattttctacatgcagagacgaccactgttggagaagctatagtaataatagtcataataataatataaaataacaataatataataatataaaccatcataaaataataattactatttctgttttgggtaggtgactaactccatgctagttcacagggtttttatgatgaaaaaaagaaggcttaagtggcatttcataacactaaatgtatttgatttaaaggactgcatgtattccaagatcatcctttctgccttttctatgtaagatggcctttctgttaaactggtgctcggcaggtgattgttttgtaaagtgctcttcttggtgaatctaaaagtcagcaaccatgtcagtctccagtgttatttttgacaattcattgctgtatgaattccaatccaggaggttccctgatttggatgacccaaaggttctgttcctcttgctcatgactacgtctgcagtatgggcagcccttcctcacactgcccagggttgcctgcaggcagtgaccctactttttctcaagcttccctgctgctgcagatcatggtgggaaagactctttctccccgcccccaccaaaaaaaaaaggagaaggaaaaagaaaaatgaagggaagaaaagataaaatagaaaaatatttggttccttggtctgggcccattgtaaatgcagtttctggaatatagacatagtttgggggattggcttctcatgtgcctaccagtggatggacagctgagggttttgctcacttggcctcagatactatgtttttattaaagtgaacttttctggggcttgatttcaagatactgagcgcagtcccctattgctggacattcacatttgccttttctgaggcctcatgattatccttagattttggaatgctggcaaaaaagcagtgtttttctcttctgggcttaatttattgtgcaggaatgactgacactcaccaagctgctggacagtgacagtggcctaatgcaatgctggaatccttctagcgtgagagcctcctacgcttaaaccagtggctcatttcttggatttccatgcttaccagactaatagctaaaaatctgcaagatcagtgtttttattcttttttgagaaagaccttgcatgttgttttgatttgtattcctagcatgacaccctgtgagagatagtgagagcacagccctgtttacagatgagggcctggcagaggccaagccgggtcctctgcagatcctaactgctgcttaccacttaaggacttttgtttctcttctgggatggaatgtactttataagcattacctggttctttctgcttaaaacaaaacaaagaaaacggaagaaaaacaggcagtgctttaccctgcaggagacagagaagatagttccgccctggcttctgtctgaaacagctgcagctcctgcagctggtgttttgccaaaacggaagctccctgttcctctggctcccacaggggttcccttctctgaccaggggagtgtgtagctctctcagttgggcactattctaagctcagcaagtaacaaaggaccagtttccctgcattctttggtttccacagcagagttcctttttccatactccttttccatttcttacatctccaaaaaacattttagctacttaggtagagaaatatctccctgggttcattcctatgagtgatctgaatgtcttttagtgtggtgaatattttaagtttccccacctcttatttgcaggctcttcctgaccattaaagtctctgatgtttacttgcaaatgaagcctgcaagcgcttatccagcaaactttttctttatagtttgactgcaggattagcaattgttttcttctagtgccttttcttttagtagagcccaacacacactgtttgcttctctcaactgctctctcctgctgtggtactttagcttatttctggactcctttttagatagatttagatagatggatagatagatagatagatagatagatatcagttgaattaaatcaagaagttacaatattgtgtttaacaagctagaaatgatctctatgaatcaggaggtgggaaagcttggccaaattagtcccattttgttgctgagaaacttgtctaggggggaactagacagtcaagcttctttgggcagctctctggactataacgaggtgtcacagcattcctaaaattctctgctcagccggaggttgtgtggaatgccattctggaaactgttggtcccttaaccttctaccttgtggtcaggttgccatcttcctgggcagagccgcgcacatctacccgctctccttcttcctcaacttgggcagaaggcataagattggctggaattttcaacacatgatgatgttttcaggtaaaaaggcgtaagtgtaaagaaaatgagttttattcagcaggtaacaagaatatgattaaaatgtaattgataaggttcataaaaagacaagcattcaagtttctggtccgtttgtatcccctgcagtgagaaatagacagatgtacatgttcagttgagttagtgttgattttgcaaaccgtactaccaaatgtgaacattctcccctaaaatatttgcatttctatttcatcactaccactcaacggacctggagatatggtgtttaaagtgcttgattgttttctagaagatcttcataacccttaagcttcctgaagggcaccagctctagaattagaaggaaaagagctcctgatgagaaagaccactggccaagtcactcaacacctcccagccgcagtatcctcccttgtaaaataatgaaattgaactaattagctgaggtcccccagctctaactttctgtggagcaaaagaaataaaatacactcatgtaagcaagagggacccaacactagaatttaataactgtgatcatcctgcttaattgacactgtctcccacatgccccccttttccctgtaaagctgagaagtctggagaagccactgaggggacaaaggacaataaagaaagctgtggaagtagagtaaggagagagcaactggcatgagtggatgatgcagtgagggtggtaagcgtcagctttatagaaatggacccaagttagagcatttctgcagaacagagggaggagaagttagttgcaaaaggctactgtgacccttaaaggcacctctgtcctttaagacagagaatgagttgcagccacctttactgccatgcagtggtcgtactgaaatcaaaccaacaggcactgctcagtaaagcagtcattttatctcatgctagcttgcctctgaacttagatacaggtacagtcttctaagatgatttccttttactctgacaaacatttattgagcatcctcttttcataagccacagctctaggttgtggagcatgcaaagaccagcctccttcatggagctcacagtccgctgcggggaggcaggtacacaaagagttaattttcttccaagagaggttggtgaattgcacaaaagaggtctgaaagaaatgtgaacaagaagagaatggctcagggccatcttcacaaagggagtggccttttagctaggcttggaagaatggaatttcaggaggcagcagtttgggaaggcagaaaagcattagcatgcctggctcgtttagggaagggcagcagtctggtttaaatgtcagatacatggagtaatgcagaaagagggtgaggttgaccaccactgccgcctaccagctgttgctgatctggcacggtgaaagtgcctggaacctggagaactgcttcagtggctggaaggacaccgccctgagcccgggagccacaaggaggcgaagtgtggtggacaggcactgcaagatactggctataagttcaacatctacttcacatcagtgcagaagagagcgatctggaccctctggacagtgccagatgccactgacctgatgtggctgcccgtagtgaggacttggcatcttaatgagtggcactctggtggtctgaccgacctccgtaaagcagaaactgctgccaagcatggtaaagatctggaggcgctcctgtgatgtcccaccacctctcatagagcccgatcatcccttctacagcagcatcagtaaagatcgcaggtatgtacccctcactgaagatcagctaccctcttgtgagggtctgaaggacacttctgccagagctctgccctttggaatgaagaaatagttccccagattaaggaggggaaatgggtactgattacagcccatggcaacagcttccccggcattgtcaagcatctggagggtctctctgcagagcagaacctgctgactgctattctcgttgtctatgaattggacaagaacttgaagcacatcaggcgcatgcagttcctgggggatgaagagaccgtgcataaagccatggaagctgtggctgcccaggataaagaaaagaggtaaaggccagcggacagactactttcgccgggaacaccttccctgcccgtcccttcctctgcccctccccactacacatgtcacactgaccacatctgtaggcatctgaagttgtagctacagatgagtaccagtggctcccatttttcatttcagccatttttctcctgcacccactgtcttcacacaatctagacaagatagcatctccggggagggcacagattttcagtccaagcccagggaaaactccccttatccaaaagagttgagaggtagggacttgggtttttaccagggctttgtgtactgaggacctgcttgagtaggagatagggaggaaccatgctaaggcatggccaatgaggagaagcaagagagcctgtttgcccccaggagccagtcctgtgttcttctgtagtcaggctactacctggagggctctagtcattccagtggaagatgaatgtaacctgcatggtgatgtaaaaaaacaaaaacaaaaacaaaaacaaaaaaaaacagtttcctccctgaccccaaaggggctggctctacttgatgagtgggatcaatcctgaattaagtttctgttgcatttattttacaaaaaaaagtatataaataatacaaaacaaaagtccttgtggagtttctagtggcagttgaaataatcccacgtgatcatcagaaaataaaccattccttataccaatatggcataagctccttgacttgtaaggggtaggagtgcctcctgctgtgtattttagaatccctgccccgccttgtttcatggcagtgaagtgcctcttgatcacgtccaagtgtgtctttcactgcctgttttctgaatcacgttttagttacttggccatgccacatgggcccagtactcattttgagcataactgtactaaatcttttttccaaatcagtataagaaaggaatgatatgcaaaaaaaaaaaaaaaaaaagggagtggggaaagaaggtgaggttggaaaggagaattgtatctaaactcataattttcaccgtttaggttacatcagaattgcccattgggcttgttaaagtgcagattgctgggcctcactgtctgattctggggatatggagtgggctcttctaacatttctgagctgccactgctgctggtttgaaaaccacactttgagaaccaccactgtaggtagagtggagacctcagagaagctccagtgctgtgccaaagagtttgagcttcactcaagagcagcagggagacattcagagcttggtgaagaggacggtgataagcttctatgtacatattaggaatatgccagtggacaagaggaagattagttggagctaaccctgtcatctaggtcaacttaaatatgctcattggcttctgtactaaaaagctgagaagtgcacagtgctgtttaatgatatctccaataaaaaatattttatgctgggagaaatctgcctatcaaaaggaactcatttgtcaaggctatgaaatacctgaggtttcactttcatattgcttaccatgcttacctaatgaaataaagaaaaatgtattatacttggtctctctctgatgcccaagttttctttgagtcagcatcccttgagaggcttaaatgttgaccagtgacatagctggctggctgtagggtgacctagatgtgtataaatatctaggacagattaatagaaaacatcaactttgttttcaatgtaacttttattgatgtcactcttctttagtgaattgtagtgaagtgctcagattacatatattaataattgtgaaattgcaaaatagaaagatgtacaaacagatatagtaggtctaagttttcattctctcgcatgttatacagtcttgcccatggtgaataaaaattaatgctagatatgtactaaagactgtagattcagtcttttttttttttttttgagacacagccttgctctgtcctccaggctggagtacagtggcaccatcttggctcactgcaacctccgcctccaggattcaagtgattctcccacctcagcctcccaagtagcagaggactacaggcacatgccatcatgcctggccaatttttgtatttttggtagagatagtgtttcaccatgttggccaggctggtctcaaactcctgagctcaggtgatccacccaccttggcctcccaaaatgctgggattataggtgtgagccaccacacccggccagattcagtctttactataaaataaattatgagcgtgatatgggaaaggaacaaaagagcttagaaggatgaactccaaaacattaaactgatggtattaatcttaaatccattaatgcagatcaggtaccagcaaactacaacccctgggccaaatctggccactgcctgtcttcacatagcccgtgagctaagaatgtcttatacagatgaatatttgtactctatttgatgtagacaacactgactttgaaacaacagttaagcaaaatatcccctccagaaagaatttccctcttttcattattagacctgtattacaacaaagtggcctcaattattattattgatttttgatagtaaacatttgtggaaatgttcgtccctttgatctaagtacccacataatattcttgattttgcctcttggcccacaaaacctaaaatctataatatctggccggttacagaaagagttgaccacccctgatgtagattgggttatgttttcacttctctgtgtggtttccccttttgctaaggaaatgctgaactgttttccacaaatttgacatactcgtacctagcctgttttttaaatttatattgactgtgtagtgcttgggttgtgttgggatcacagttttagcttatattattttttacttatttatattttacttcatgttactagcagaatcatgtaagtaataggagtgttattattctgaaaaagtgctgtacaaagcagtacaatgctttttcattgtgttggggagttttgcaaaagacagcatcaaataaaagaaaatcatgcctttaaggttcttctttctgagtaaaacaacttggcccctgaagcatgaatgaatagagtttattagccccaaatggcagcagtgcattttgagacaacattgtcatttaatccttataagtagatcttcttctttggtccccgcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcaggttggtttggaaccaaggctaattgagtatgtcagttgtcaccgttcctgagaatgttcaacaacctgtgcaggatgtgctactttagttcatggaaaccttttacagtctttggttttgtttgtgaggggggattaacaattttttttaaaacaataagtaaaagtttggagtatggggttttccaggagaaaaaatgtagtcattaaaaatttttgtcagtgcaaacatacaaagaatgagaagtgcctggatcttgctagaacagtgacattagagcaaaaatttaaaaagtcttaaagctgcgggagagaaaatagaccaagagcccctggcagagtccagtatttcatgttcctttgaaatgaaatccagactctgaagaataagctcaccagccagaaatagaggcaattagagttttattttagcatgaagctgtatgctgtctcttcttgcttgagtgtacaaaagaggtgacatttcctgggtaaccctcacctgttgcagtttcatggatgtcctctgcctgtggctttgtagctgtgtcaggacagaaggagcactgatacgagtttgactttttcaagagcgcttgaattccaaattgtgtttgtgagctccagcatcttatggtaaagaggtcactggaaataaggttcaagagacccacagcccaactctggcttgggttaaagacaagcccctcatgtctttgggcctcaggtttcctcagtgttaagtgaagacactctgccaggtgatttcaagggcacttcagctgtaggtgtcgtgctgcacatcactggatgtgctctggccacttgccacagtttcaggtctgcagagggtgaccgtgttctggaacaagaagacacttgggtagtgcaaaggtgtgaataaaaattctctgaaaagccacaaggtggcaatggtttttctttctctgctggcttttttagtttgtattctctagactgtagaatgcccgacacagctgcagagcgtacatagcttggaggagagaaaatgaacagagatctcccagtcatccttggggttggggggaagaaactaaaatttgagagaatcatctcctgtgtctggggtttttgtatagatgttaggcagagattcctgggctgccacttctgctgccagccactgccacttccacttccactgccagcttcaccatttctgggctagtgtatctctgcctgagatccaggtgggtctgcagaaccaatatggggtttatcagtgttagtcataataataagtaacacttacgttgcaggcattgttccagataccatacatatattaagataattctcataacattcttataagggagataggactattatctcaattttagagttggggaaactgaggcacaaagcagtaatttgcccaaggtcacagagctttaagtggacaagctaggatttgaacctaggcactcataccacagagtccacactcttaaccactgtgctatactgcctgtaagaagagttataaaatttgggaaggttagaatttcagtttcctggcatgaatctcaagggttggattaaggaaaagaatccatctttgagaatataaacctgaagaaaatttacagtctcttacttttaaacttaagacataagatggtaccatctttgttctatgtagcagaattagggcaagaaaaaaggtttaccctctacacagttgagaatctttgcatttggtgacctctgagattacttcctgctcctgtttgtctggtcacctagtagatgctctggatgctcagagcctcattaaatcatgtttgtttttcatgctagtttataaatccttttctcccccacccctcaaacatatacgggaccaaataattttccattgagagtagagagttgacttttgacattttgctgttgtaactgccttggagatccatgtaggttgttcatgtatcaagtttgttctgttttattgcagagtagcattccaaggtgggcctgccacattcctcctctggtccctgctgcctaattagtggctccagccactaatttaaccatttacccctcgaaggacatttggatagtttcaagttttaggctattataaataaagccactgtgaatattcttgtgtaggtttttgcatgggcataaatttttacctctgcaagatagatgcccaggagtgtgccttctgtgttggatagtaaacgtgtttagttttataagaaactgccaactgttttccagagtggctgtaccattgtacattcccaccagcagtgtatgagggatccagtttctcagcatcccccccagcatttggtattgtcagggtatttcatttcagctgttccaataggtatgtgggaatatctcattgtggtcttaatttgcatttctctcatagataatgatattaagcatgacttcatgtgtttatttaccatttatatgtcttctttggtgaaatatctgttcaagtcttttgtccatttttaaattggattgtttgtttctttgttgagtttttagagttctttattctagactgtagtcttttgtcagatacatggtttgcaaatattttttcccagtgtgtagcttgtcttttaatccttttaatagggtctttcatagagcagaagttttaatttataatttatcattttttttcttttatgggtcatgcatttggtatcatgtctaaggactccaccaagccttaggcctgaagatttcttctgcgttatcttctaaaagctttttagttttacactgtacatttaagtctgtgatccattttgagttaatttttatataagatgtgaggtttaggttgaggttttatttgccaatggctatccagttgttctagcataatatgttaaaaagactatcctactccattgaattaattttgctcctttgtcaaaaatcagttgtctctatgcatgggggtgtctttctgcactgctctattggtttatgtgtctatccttccaagaccatactgtcttgatgactatacttacgcagcaaaccttagcatcagagtgattcctcccactttattgttatggctattctagttcctttccatataaattttggaataaatttgtctacatgtaaaaaaaatcttgctgggtctttcataggaattatgttaaacctttacattaatttttggggagattgacatctttattatgttgaatcttccaatccatgaacatgatatatttctccatttatttagaacttctttgatttctttcattcgatttttgcagttttcagcaaccaagtcctgtacatgttttgttagtacttgtatcctgtcaccttactgctgaactcacttactagttctttagttctgaaagtgttttggtccttttttttttttttggtagattcttttgaattttctacatagaccatatagaccatcatggtatttgtaaatagccacagttttttttttttccttccttttcaaccagtgtaccttttgtgtccttttcttgccttattgctctggttaggattttcactactatgtagaataagagtggtataaatggacatcctcatcttgtttctgatcttaagaggaaagcattttccagggacggtggctcacatctgtaatcccagcactttgggaggctgaggtgggcggatcacaaggtcaggagttcgagaccagcctgaccaacatggtgaaaccctgtctctactaaaaatacaaaaaattagcttggagtggtggcaggtgcctgtagtcccagctacttgggaggctgaggcgggagaatggcgtgaacccaggaggcagaacttgcagtgagctgagatcacgccactgcactccagcctgggcgacagagcgagactccatctcaaaaaaaaaaaaaaaaagaggaaagcattcggtcttgccttattaactataatattagctatagggtttttgtagatgttcatcttcaagttgaggaagttcctacctattgctagttttctgagagtttttttcatgaacaggtattgaattttatcaaatattttttctgtatcaattgatatgatcatatgatttttcttgtttagcctattaatatagtgaattacattgattacttttcaaatattgaaccagccttgtttctctgaaataaaccccacttgatgtggtatattattcttttacatattgctgaattatatgagcaaacattttgttaaggatttttatgtctgtattcatgagggatattggtagtagtttttttttgtactgcttttgtctgtttttggtatcagagtaatctggcctcacaaaatgagttggacatgttcctgactctttttttttctggaagagattgtgtagaattggtgttaattatttttcttaaacttttggtagaattctccagtgaaaccatctgggcctggagacttcttttttgggagtttttcaattatgaagccaatttctttattagttatagggcttttcagatgacctatttcatattgggtaagttgtggtaatttgtgaaattggtcagtttcatttaagttgtcaagtttatgttgtttgtagcattcccttgttatccttttgatgtctgtggggtctatagtgatattccatttttgatatatcttctctgtttttggtcggtcttgctagacatttgccaattttattgatcttttctaaagaaccagctatttatttcattgattttctgtattgtttttctaatttcattttaattgatttctatctttatcaatttccttccttctgtctgactctatccagacagcataatgccattactgaaaaatatatatgtgtcagctcgttgcatttttccagatgtgtataaataatgattacataagtgtagaaactgacatttacagagattacatcaaaagaaattccctctgaaataaggtaataaaacagattaatttttctggcttgtggcttgtggtgtgatggccatgaatcatttctgtaacccaggttcttattctaaattgattcagaaaccccctgaaattcagtttggcattttgacccctgtgacctcgatatgatcagcactgactcattctttacttctccaggctactgatagaggccctgatgagctgttaagtagctgcccagaagtcagaagcccagggtggttcttggagttcaccataaataggagttagctgtgtttcttactatggctaatttcaagtctgtgtataaaataaaaatgaatataactataaatccaaagccaggtcactgctttccataaatccaatttatctttttacattggtgttttgtgattgatattttaaaacataatggcaaaatgtgcaaattgctttctgttgaaacataatatttttctcagtctcttgagtaagagttgttattgacaaaggacataattttggcaacttaaaaaatgatggtgggattattttgcctgatgagcctgtgtgtgtcctgaccacattgtgacagcatggtggccgtcttctaggagccgtcagcttcaagtaacacacacgaaatggtggagatagtgggttgggggggcggtggaacgacatacacccaggtggccaaatgaactgtaactttcacattccagggtgtagtaatataatccttcaaggacaagtaagaatgctctacttggcataatcctgttagactgagaatttataataaagctctttgcaagataacataaggaataaaggcagggagaagccctgagctctttatgtaataacatttgcaactggatattttaaaagaacttaaatatgcctccttggaatcaaaggcagtatcctataagaggaagagctgaggctctggagacgagcagcttgagttggaatcttggctctaccatttctacctttgtgaccttgggcaacttatttcacctgtatccctcagtttcctcactgattaaatggggacagtcatagtgtgaggataaaatgtggtaataaataatgcaatgaaaaattctctcatcaatgtatcatctgacacataagcacttagtatattttagctgttatattaatagtattaatcatagcattacagctgctactattattaatactatttctcaagagacaatgaatcttacattaaggaatctggcttgtttttctggtgtttgctataatttttcgatgttgtagtaatagagtctgatttaagtcacattctgaacatgtaactaattaaaagtaccaccttaagaagcatcgtgtcctcacttgcatatgtcagggaatattaataacatgagaatttgggcattgtctagtgaagtagttctcaatctttttttcgttattgccgctgctgaggagcctttaaaaactttttcctcagttacctcccccagtgaaatttgaatatcacagatctgctatgcatctctgtctgtgctgtggcactttggagggttacaaaccatcataatatctgagtggttttttttttttaacctacaagaaccaatttttatacccatgagggtgatactgcctccattgagaaaacgtggttcagtgcagtgatttttcaactgagggcaattttgccgcccaggggacatttatttggcagtatctggagatgtttttagttggccacaaccagaggaaggggtcaaaacctcagcttcttggtgggtggggttgctactagtatcttgtgggtgaaagccggagactctgttaaacatcttacagtgagtgcaccatgcgggtcaccacaacagagaattatctgacccaaaatgtcaatgctgccgagtttacgaaaccctgctccaacatgatggtaagattcaaatgcactctaagtaacccagaaattattaaggaaggtgaaggtggaccatgtcaattcaaaaggctacaagctaaagagaatagcagaagttgggttgccgactttcaggttgatcctatgtacaacatggtgtgcttgtctggaaaaaaaggccatctttgtcttcttaagtattgttgctgtttttcaataatatcatgctttttgttctttctgtcaaatatgtgtaaaaatatgtgtaaacactttaaatatgtgtaacatatttaagcaacaatttcttttttctatttttggtatctttataaacaaatgaatttctgaaaaaattatgtaaatttgttttctatgaggtgtatttcatcctctgattttattacattatattttgaggggctcatcctcattcctgatcaatcctcatttgacctggctcttgacattgttgccttaaatttaaatttagtggcctctcagcctctctgggttttagaggatggggacagtttaagagaagatatggattcatattgaaagtgaaaaatattctctggtggacatggtccagatcatttgcccagagctcctggctctcctgttgtccctgtcacactcacgttcccttcttctgctgcccagagttggcgtcgaggagccctccgaagaggaccagaatgaacaccactggcagtacttcaggtgacacaagggcatcctcagaaaaaattaactgggcctggcttttctcctctttctaacctcagatatttctctttacactatttttctcttccttcctgcgtgtgccaacccccacttttagtaaaggtgcaaaaggttgagtcaattctaatcattttttccacccctcctctgggttgattgatgtgtcagtgttcttgggattctgtctgctttccccacatttaggcaatgtattgccaacataaagcctgagttgtcaagtgtctccttttcgtacaactgagcttagtgttaagagcagctcactttcagagccacacttttcccacaaaatcctgcttgtgatctagtaaataaggctcttaattcataaagagaactagaattttcatatttcaaccatgactggggtaaggcttacaccatcttagttaaataccactgctattatagtttttcaaaatacatatttgtgtacttgtgccttgtcatggtgaaccagaagatatgaagaatgtttaaccaaaaagataaagattcctctaatgcagtttgtttcttgtatccttccaagtttatgatataactatgcttaagggtggtgatgtctgggcaagcaaagtacaaactttaatgtttcttctttcctttctgtttctctaattggcatgttttcttcctgatctgattctcggtgctgatagataaatcaaatgcaaaataggcttcaactctgttctcggcactgtgagaatatctcacttccttgagggcagtggtgaaagcagtgggacatgggtcttgggatatcactaggccccgtatgtgtactgtaatgactcacatgaaattactttaagtatttaagctcactgaaatcacacttttttctacacacacatgttcatttttggagactgactttgataccagctaaattgcagaggaaaccctttcctttgaagcatgccttcaagaaggaaagtccttcaggcaaagtgtaagttattagacttgggacatgagcaaattcagattatgatatggtgttcaaggtgttatatgaagatgtgtgtctcatattcctcaaattattcaaaaccttgaccattcagggttttttttttagaaaaaattattaattaacatggaatacttctaaactttccgagattttatggcattttatctgttaatcagaatggacaaattataccagcagagaaattatcaatgatattatcaatatcattctggtatttattcattccagaatgagcacatcagtttgcttgctttatttattcatttagtgtgggatgtccacatttatctaattcctaatgaaaataaagataattctgcccattctggaagaaaaggctgtcatttgtgttcttatgagcttagccctgatgtatcaggggaatgctaaaataagatataataaaacagcataaaaaagttccagtgtcctggatcaaaagcgttataccaggtcaggagagagatacataaagtggacagtgacctggcactaggaatttcagaaagttgggggaccctaaagtcttctgaggctttaaacctgcaattaaaatcctgtacctgggccgggcatggtggctcacgcctgtaatcccagcactttgggaggccgaggtgggcagatcacctgaagtcaggagttcgagaccagcctggccaacatggtgaaacaccgtctctactaaaaatacaaaaattagccaggcatggtggtacctgcctgtagtcccagctgctcgggaggctgagtcaggggaatcacttgaacccgggagatggaggttgcagtgagctaagatcacaccagtgcactccatcctgggtgacagagtgagactccgtctcaaaaaaattcaccaaaaaaaaaaaaaaaaaaatcctgtgcctgttctttcttgctgcccagttccacaccaaaacaccctggcccattgctttacctcctcttcccagagatcagtttggttctgggctctgccccaagggtggggctctttgtaggaagccacaaggtcccgtgtcatccttggggattggtccaagaggccctcaaccctgccagaaaagtaattactaaatcgccctaaagtaaacaaccttgaataggggaaaaaaagtgcaaaacattatttgtgtctcacggccccgatctgtttttttttttttttttttttttttttttttttttttttttttttagcagcagcaagctgagaagcagctctttgtttcctttcttagaaatctcctgttctgcacttatatcagtagcaaggccctccaagagaccccaagggccttcccacactcctctgtctgtggcagggcccaggaggttcttttagactctctgctgtcaggagtttgggctgcatttcatacttggttgatatcaagtggctgccgtgaaggtcggaacttccatggcagatataggattttcctggcatcttttttctttcccccattgcccagtgttatccatgtcatccatggcacagtatcctgcctcagaatgaggaaggtgcaaggataaaaaaaaaaattgccagatgcatagagtgccagttagtatgtttctaagccaagacaactgccctggtgcttttatagtatttgttataaatgagtcctgccattttgctttttctttctgtctttagttgttgctctcaaatgtgtgagttctcaaggctatcttgatgcaagagggtataggggcaccaggattgaaagcaggtcaggactctaattaatgatattgttaaagaaaacattattctgatgtatatttaaacagtaaggcagacgttgttcaggaccatcacgattggaatagggaccactgtgatggggttttgcagcaggggagagaaacgggtcagtggatagggaagtactgagaggaaatatcaggggcaagggggattctggctaaactgacccaataggattcttgctgaagacaggcgaaggggattagacaccacctgagggattgtggggggatgaagaatccaatcagatgttggggataggccattcagatgttgggctgtggccaaaccaacttagacaatcagacatcacctgagggattgtggggggatgaagaacccaatcagatgttcggttctggccaaaccaacttagcaaacctcttgctaaaattgggctatgctgagatggacatggaagcccaaaagtcagtgcctagttgggaagtgaattcctaggagcctgactaaagtttggtcaaggagagactctttgtcaatatgcacgtgaagtatttaggggaagtattctgatgtctgcaactttatctgaatgtatccaaagaaaaagtaagatgggtgatagagaaatggatagataggtaataaggaatatacagtaaaatgttaatggtagagtctagtgatggtgggtatataggggttcactctaaagtctttcaacatctccctgtatatttgaaaaagtttataacagaatgttagagaaattaaagcaggccagggcagaagtgaggaagcagcacaaaggaagggcccagtgcagtgagacccccattttgataactgggaccacctggtgcagaaaagcaagtggacagttgccagcatgtgttgtgttccggcggccttgcttagagtgtgagcacatgggattcatcgcccctctgaccctctgggatctgaagtggtatgcgacctctttcttatgacttctgcatgacagctttcctcaccttttagctaaccactccttatgcttcgggaagatgattagcctccaggctacttgcagcctgcatggctaccatgggccaagctaatacgctctgtttttctctttgtctttctccctggtgactttcagagttggtgttgaccccgatcaagacccaccacccaacaacgacagctttcaagtcttacaaggggtaagtcacaagagatgcttcttcctggggaagacatttgagcattcgccacatgccaggcactttacctagattccctcaatgtgatcctgacaacagccttatgaagcgtgtactgctctccccattttacagattaaaagttgaagtttgggagtttgagtcatctcagaataagtgatggagccaggatttgtccccagggtatgtgttcttaatcaacattatgaagggtgtgggctcgccagaaagagtccctgactctccacttttcaatagtggatattggttctacaactggttccgagtctatcagtggtgcccaggagaaagagagcaatacgatttgactctccagcccagggatctgaggaagaaaggagagacatcaggtgcctgaaggcattcctgtttctccagggcctgggatcctctaggtgagcaatttggaaagggcatagcagggacggcttgccttttctccatgaagtccacggccccaggtgggaaaaccaggagcctggggctggaatcatgcaaaggttcatttactcatatgtctggcacctgggctggaaggacccaaccacaaggacttctgacaggaatgtctgtgcagggcttttccatgtggcctgagctgcctgccagcatggtggctgctgggtagttggatttcttatgtgatggcttaaggttccaaaagcaagtgtcccagcaagcaaggtagaggctatatcaccttttctgacctaatcttgcaagttctacagcatcacttccgtggctttctattgcttagaaatgcattcctaagaccagcccagacccaatgggaggggatagagaccataacctctggatgggaagagtatcaacaaatttacagacaagaattgaggttgccatatcatccctgttgtgcagctgtcgggatgattttgtctctaggtctggctctttatccaggtcagcatgacctgggcaggcaaggtggggaaaggagagttatgataggggcagaaatgtgttaccaatatattatttgaccttgggagtcaataactatgtcgttcagcattgaatgcccagtgctgagcacagtggctggcacatgcaggaacctgataggtgtttgttgggtggatgagggaatgagagagatgcagcatgcaacaggcagctttactgaccacctgtgtatgttgtccatgaaaccctattcttttttttccagtcagctttgaatctgactcatcattgcacttaatcctgcagcagtctgcagcagacttcacattccataggatcttctaaatgattccatctaccaaatcagatttaataaggctggcaaaatgtggtgctgtgtggggtcaatggggtgccactgtggccttttgtggtttctttctctttaagggtggccacagcctgataaggcatttatagcattgatgtccattctaggtccctgctcaagggacacaaagccatgacctggaaagttctggacattttgggaagagttttcaataagcttcattggagatttggcacccactttaatgagctccagaagacctttgagatgatcttagaattggccattatgtcagttgggagcatgtggtctcagtgagttctctttgaaaatttgctatttgactctagctttgattaaggactttagaaaacaggagttcaggaactgagcacctcgaggctaatttagagtataacagtttgggagatcttgaaactcagcctgagaaaaccccaggggaaaacatgatggccgtccttatttcaccaaaggaaagataatggctctggtaggacatggctgccctattctaaagcatcctccacagaactgtggccagtctagattaattttgtaagaaaaaaaggccaatagcagctggatcataagatttggagagatttcatcttgctctggaccattcaaaacatccccaccccctttgctgtttcccattgctcctacctctgcattcaagcatctgtaacaggaaataagtgaaaggatttggctggtcatgtagtagaacttactatgtatcacatgagccctgcgcactgggaacactgggcttgtaattagattcagtaacaagcttactgtcacttttctgtggaaatgtttgagtgagaaagcagcaggtccaaagtgctgagggttcttgtatttagtccatgcagtaacagctaaaatagcccccacccccaggtggagtgagtctcaggaacctccctggatgggcctggatggatgaactcagtgttcctgtcagctcccagagggccccttgggctgagagcaccgcacatgtggtgttgtgaacgggctggcagccactcgcgctgcactcctaatggcaccctgtttgccacagccctagccagaagctgtgtcacagcttccccctgacctccttccttccagacctcatacacagtcatgcagagggcccctcaaagtcagttccactgaccttttgaaaggttttcaagattgctgtcatatggggaaaaacatgcaaacttcaagcttggttctccaggacaccctcttagaaatgactcacgcccttgtgcagagaggaccttatttctccagttcctcctggtctgacctcctcattctagtgagccactaacagcagggctcagtgcactctgtggccatgagaaacaggaaaacagaaataaatgggcttctcatttttgggtgaaaccctgggttcttgcagtttcccctgaaatagatccaggtcacatgctcagtgttgtcatgaaactgaaatcagaggtagggaaagtccagatgtttgttctccaccagagaaaaaaaagggcggttctctttacctcattttctaaataatcttcctaaaaacaacaaacaaaaaagtgacatttgatgggaaggcatgtcttataatgagcacaattctcctcactggtcttgaagcccaaggctataaacagagtcatggctagggagctacagaatattagctcatgtgggaaaaggaagggagctgttggctagaactttgcttcatgtggggaaagcataaaaatattgtgggcagacttcagctttgtgtcccctggtaagtttgactcattagaacaaaacaagacaaaaaaaacaaaaaacaaaaaacaaaactcagtgctttgtttctctggaggtcttggtgactttgcaaccaaaacaaaaacaaccctagctggaggcaagctgcccagccctgggggtggcctcccaccccgataaagcaggggacttttcatgccagaccagacagctgagatttctgttggccgtacatgcagacacatcattcacttccttccctgagtttacagaagagcactcattgatgaggccactttggagcagctaagagtgtgaatctgaatttatcccagtttcaccatatcaacaggacaaggtcacaagccggatattaatggagtgtggaggaaaggaaaccaccaatgcctgtgtatatgcacacgtgtgtgcgtgtctgtctgtgtgtatgtagtgaaaactgtagaaaatcagcagtttattgttgcgttcacatatgactttctgagcaagttagaatcatttgtttctgggtcctccgtgtttttttttgtttgtttttgtttctccaggctgaaatctgatacccgtaaatctgtcacctaaatctttaacttcaaacagttgcagaggtgcctttcctccagttgctactctgtgaccaccgccccccccccaacccgcccatttttttgtgcttccaagtgcctcccttggcccctgatttccctttctgctcttccttttctgttttctaaaaactcagagtcaagatcaatttattcatttatttgacaaatagttattgagcacctgttctatttcaggcattctttcaggttctgggaaaatatctgcaacaaggtagatgaatctgcatcctgaagggcttggtgacaaggtgataaagggtgagggtggagagtggcagaagcaagagagtggagacactcaggcctcaccagccccactgaagcagaatctgcattttaacagtgtctccagggaatgtgtgtacattttaccattagaaaagccctgatctaggcaatgtatagctctggagagttttaagcagggaagaaaactatctgtgtatcacggtcagagatttgactctggttttttttttgttttgttttgagacagggtttccctctgacgccaaggctggagtgcagtggtgcaatcacagctcattgcagccttgacctcttgggcccgagggatcctcctccctcggcctcctgagtagctaggaccacaggtgtgtgccacttcaccaagctaatttataaaatatttttctagagacagggtcttgctttgttgcacaggctggtctcaaactcctgggctcaagtgatcttaaccctcccaaagtgcagggattacaggcatgagcccactgcctggctgattccctgtttctaaaccctattattaccctctgctgagaaatcttggatccattatcccaatgatatgacaaaggccctgtattagtccattcccacacttctataaagaaccacctgaggctgggtaatttatgaagaaaaggtttaattgactcatagttctgcaagctgtacaggaagcatagctgggaggcctcaggaaacgcacaatcatagtgaaggcaaaggggaagcaaacacatcttaccatagcggagcaggagagagagagagcaagggggaagtgccgcacacttttaaccagatctcgtgagaactcactcactatcacaagaacagcaagggggaagtctgcccccatgatccagccacctcttaccaggccccacctccaacgcttaggatcacaacttgagatgagacttgtgggggtacacagagcccaaacataccaggcccaggccgggcgtggtggctcacacctgtaatcccagcacttcgggaggccaaggcaggtggatcacctgaggtcaggagttcaagaccagcctggccaacatggcaaaaccccatctctactaaaaatacaaaaattagctgggcatggtggcaggcacctgtaatcccagctacttggaaggctgaggcaggagaatcgcttgatcccgggaggcggaggttgcagtgagccgagatcacaccactgcactgtagcctgggtgacacagcgagactccatgtccgaaaaagaaaaaaagcatatcaggcccaaatcaagtgacatcatttatttactcttctgctccatattagttgtctgtgactgctgtaacaaattaccacaaatttagtggcttaaaacaataaagttttgtttttgtttttgtttttttttaagggacagagtttcaccatgttggggctggtcttgaactccttggctcaagtgatctgcctgtcttggcctcccaaagtgctgggattataggcatgggccaccatgcccagccaaaacaatacagttttgtcatccttacagttcagtagatcagatacctggtgggctcagctggtttctctgcttcaagtttttcaaggtgttggcaaggctaagctctggggagaagccacttccaggctcattcaggttgtcagtagaattcagttccatgtggttgtaggactgaggtcctgtgttcttgctgcaaagccagcaacagtggggcaagtcaagctctgaatctctcccgccctttcttctactgcattccttcctctgactcttttgccctccatgtcctttttttttttttttttttttgagagagagacagtcttgctctattgcccaggctggagtgcagtgatgtgatctcagctcactgcaacctccacctcccaggttcaagcaattcttgtgcctcagcctcctgagtagctgggattacaggtgtgtgccaccacacccagctaatttttgtattttcagtagagaccgggtttcgccatgatggccaggctggtcttgaactcctgacctcaagtgatctgcccacctcagcctcccaaagttctgggattacaggcgtgagccactatgcctggccctccttgtccacttttaagggcccacgtgattgtcctgggcctacctggataaccttaagtccatccacaaagccttttgccaggtagtgtaacaggatccagggattaggctgtagaaagctttggtggggtggccattattctgcctaccacatgctccatccctgaaaaaaaaaaaaaaagtaagctgttcttattagtgtaatgaccttatcttttaaaaacatcttttaatattatataagaatggaatgaaatgtaactctacacagatatcattatgcattcattctagaaaaattatttcaaaaataggactgtttgctattccccagttctttaatcagctttctttttcttcattatatttgtcagtcaatatgtatttgtctgtctcccctccccctaccccccaaccctcgccaccttcaccttctggaaagagtgctccttgaggcccaggtgctaagttacattcctctttgtgtttccagcacccagcatggtgcctggcacatagtaggtgcttaatgaatgcagaagaaatagacactcattgttacatgctcaaaaaatgataataagcagggttggtggtattttcttgaaggggcttctctattaataatggcagtaaaaagatgaaaattccttgtgtaaaaagccacacaagatagccaaatgatgttaatggctaggcgtttttttcccccaaacaaatatgtgcttgaaattacatatccagtctttggaaatgaacttaattagtaatatgagctctaactacatgccagattctgggttaaatatttcacaaatatttaatcagcacaaaaagtcacatggcaaacaataatgagtcaatatttgttgagtgcttgccacatatcagacaccatcctaagttctttaaatgaaaaatcttttacagttctaaaattaaaacctattttctctacattcacaccacttttaatgccaaatatgtagggtctttttgtataccagccagttctccaattcccaatgagtaccaactggacctcctacagtttaactcactacgtacctggagttagcgtcagatcccacaggttaaggactcagtcccacaagactgtccccacttcagacaccagttgcaagtcccaggtcgtgacctgtacttcagactgactggctataggggggggttcccaacccctcctcaggttcgataatttgctagaatgactcacagaacacaacttttaccattaccagtttgttataaaggatacaactcggaaatagcctaatggaagagatgcatagggcaaaggatggggatgggagtatgtggcgccaacttggaagccctccaaattgtgtcatttagggttttatggaggtttcattacataggcatggttgattaaattagtagccattggtaattaactcaatccccagtcctcccctcctaggaggttgggatggggctaaaagttccaatcctctaattacatggttggtttctctggcaatcagtgtccattcaagagtcaccttattagcataaattcaggtgtgcttgaaaggagcttattattaataaaaaaagatgttcctcccaccccatctactcaggaaattccaagggttttaggagttttatgtcagacaaaaaccagatatatatttcttgttctatcacaacattacagcctcataatgcccctagaggtaggtaattattaatatttccagtttacagatgaggatactgaagcacagaaaggttaggtaacttgcccagcatcacacagcaagacaatggcagcggcacagtcaggagccagatagtctcttgagagagcctgtgatatccacacctacacttcttggagtgctatgtcgcttttgaaacatttcttagagaagccacgcttctgcacaggcttgaaaggtgaatagaggttggccgggtaggtgttctgggtgggagaaggtgagaggaaaaaagaatgctccaggccctagaagttgcctgagctgaagacatgaggtgcgaacccaggttttgaggaggggcgagttgagagagcaagtctgtgctttttctgtggacggcacaggagtggaaaatccaagagtcgccaagtacagccaggaaggaggctccgcctgttcccacagtgacccttcctcagtccggtgctgttcggagcccacaggaagggctctcaatggcttctctgtgacagcagccccaatcatgtcatgaagcagttattgcttgtcttccgggtcagctttaaaaaattagttctgtcccacagaactgccctgatttccccaaagccaccatatgtggatttatctaagttcttcctatacctaatcatgcttctggcaccatctcttggaataagaagttgtttaacacccttttcacaaagttacacctttgatttgtcctgaatttaccccttgtagcctctaagcgttgtttcttagttcttacatttcgggatttgctgtggagtctgaggtcactttatcttattcatggattgcaggcatatctttccgtagcctgagaagaccttttgttagtttgctgtcaaaccattcccttgctttactcattttaattgtcttttttggggcttatataagtctcttgtagctttctttttttaaatttaacttttaacttccggggttcttgtagctttcttgagattaaatggcaagaaattaagtagtccagtgataataaatgctttgtggttttgcagaggttaagatgacagagtagggttcattgttttcatcattgatttaagggaagaagcggaagaaactgactttggggtactcgttttgtgcctgatggtttaatagtatccttcctgatgatgtttatcgttgtgctggctttttccttagtaaaattctacaggcacttagaactgagaacttagagcctattactttataaagaaccatttgattttttccattatatatttgcctatcaaaaaagtcatctgctacttttctactcagtcatgtggcattttggaatcttcccagagttgtcattgggttagcaatcagtcaccctgcaaatggaggcatttctgtgctctctctcttgctcatgatttataaaaatgtaaaatcaaattggtctctggggtctctccttgtttatatttcctcatccacagaagggcccatttaactgagccatttccatatccatcactaaacattcctgaaataccgaggggattcaatttttaaaaataatctttgctgttggaaactttaggagtgtattaataaatagtgcttgctaatttctctccttctcttgtctatgtgcttctcaaagatctttgattaattatttgatgttgccattgcgggtagaatttacattcaccatgatttaaaactacttgtaattttggttcaagttgtatttggtgattgtcaattgtccctcacttgcagagttgcctctccctgtaatattaaagagaatgatgataataatagcttcacaagcagtctgtgcttgcacagccctagtagtaccctcaaattgctgcagtcagtctgagttttatattaactgtgctgcttctgatacttgcacagaacagatttcctaaacctcaaatgaatgtttgattttgcaggttattttgaaagttacacgatggggatgtttaaactggaagggcatgagagtagcaaggaacttgctacttgatggtagataaaataacagaattgttagttcgagctcgtttctcctgcccactgatcccaccttcctaaagctggtggggaaacaagtaccttaccacctggagcacagtgtaggtccctgggtaaggaccacagagaagccttaactagtttgtcaggatactcaacaatatgtggtttccacaggcctactttggggatgaggattggaaagttgcttttacaaaaagcttttaaaaatattcgctataaatcaattttggcctgttagtatctagagtattttagggtaattaatctgctgaaagacactttgaggaaaattgcaataagaatgccaaaagaaatgttgttccatattaagtttgagctatccacaggcataacccagcctttttactttggagactgatttttctgccttttgagtttaatttctgctcaaatgctacctcccaatatatctttgaaactttgctgacatgggatgtttgactatgagctccagagctatacaagttattaaaaaaggttttttttcccctttctttgagatcccttttgtacaactaagcatgtgccctcttgtttgttcctaggacggcccagattctgccagaggaaaccggacaaaacaggagagcgcatggatattcaggctgtggtacagctttgatcacaagtatccttttaagtagcatcccctgtgtcggtgaaacattggggatgaaatcttgttgaattgtcggtgaatgacacctgataagtaaggaaagatgcatgcttgggacagggatagcccatcctcttatggaacgtgtgcattgagcattcaaccataggtagtcctggtgagtatctctctggccaagaggaatgtttgcatatccttagagtaaccagcccacagcctggtagactcatgtggctcttaagagctttgtgtccagggaactatgcctttttaggtgattagattaaaattacgcaatgaatcgtgctgtggtcagaaaaggaagtagaacttcagctgttaatccatatggggaggataattcctattggatgaactcggccaagtctgatcttgtatgatctgatactggcataactgggccacatgcagggcaaaccctgttccagtagattcacttggtctcaagtgaaaattaaaaaccaaaatgttaaaccctcatggttttttttgtttgttttgtttgtttgtttgttttttgtttttgagatgaggtctcactccattgcccaggctggagtgtggtggcgcactcagctcactgcaaccttcccctcccaggctcaagcaatctcccacctcagcctcccaagtagctgggaccacaggtgcatgccaccgcacccagctaattttttgtatttttggtagagatagggtttcgccatattgcccaggctggtctcgaactcctgggctcaagcaatctgcccacctcagcctcccaaggtgctgggattacaggcatgagccacttcacccaacccctcatggtttcttaagttgacatagtcatcaaatgggcaggtggcttattatatatggtctttggagacgccaaaactgttaaaaatttattgaagtatagtagatatacagaaaagtacacaaataataagtgctcagtaaattatcagaaaataaacacactcatttaacaccaaacgaatcaagaaacaaaattccaaggctgggcatagtagctcatgcctttagtcccagtactttgggaggccaaggcaggtggatcacttgagcccaggaattatagaccagcctgggcaacatgatgaaaccctgtctctacaaaaaatacaaaaattagtcaggtatggtggcacacacctgtagtccagctacttgggccctgtctccaaaaaaaaaaaaagaaagaaagaaaattgccaaacccctcatgccatgactcaattactaccccttccccctccccaaatgtaattgctctgttgacttctagcaacacttaatagttttacctgtttttcaactttctgtaaataggattatacagtatatatattttagtgtctggcttatttggcttgacattatgtgtataatacagccatgttgttatgtgtagttctagttcatttgttctccttgttccatagtatttcttatataaatatatcacaatttattctattattgatgtacatgtcttttgatgtacatatacatattttttttggtaatctacccaggagtaacattgctgggtaataggacatgggtaggttcaactttagaagatagtgccagttttccaaaatagtggtactactttacacagtcacttctagcatatgagagttccagttactccacatcctaccaacatttggtgttgtcagtctttttaattttagccattctattgggtttgtagtggtatttaatcatggctttaatttgcatttctcagatgactgatagggttgagcacctttgcatatatttactggccatttggtatgtttctttgtgaagtgcctgttcaagtcttttgcccatttttctattgagttgtctgcctttttcttactgatttgtaagagttctttgtgcattctggatatgagtcttttgctgatcatacatgataaaaatatctgctaccactttgtaacttgccttttcactttttttttttttttgagacagagtctcactctgtcacccaggctggagtgcagtggtgtgatctcaactcactgcagcctcttcctcccgggttcaagtgattctcatgccttagcctcccgagtagctgggattacaggcacacaccactacacctggctaatttttgtatttttagtagataggaggttttaccatgttgcccaggctggtctggaactcctggcctcaagttatccacctgccttggcctcccaaagtgctgggattacaggcgtgagccaccatacccagcctcactttttaaatagaatattttgatgaacaaaaggtcttaatccaatgtattgatctcctagttagtattttttatgtcctgtttcagaaatctttgcctaccccaaagtcatgaagccaatttcctatgttatcttctagaagctttattgttggtcttctgtgcatctctttttttttactgagtgacaagcatgggcaattttttctctagaaaaaaaatctagagataatttgagatgctctgcctaacatcatcatccttcagagatgatttaagcttatatctgatcagtggctaggctaggggtattagcaattgcagatcactttaatccaaacaggaataaggatgatttgatgctgggccctagttcctgtgagagttagtcttgactgttttctctttaccctttattctaggatccccacctaaagcctggtttccatcttcttcctcagtaggccctggactttcttttttgtcaggttcactctatctttgtgactctgccaaatgctctgctctgtttcttaggtgcctttagggaaactgtggctcaccaaccacagggctcacctctttggtttcctcctctcaaattccacccctcttcactgccttggtagctttctgaagccttcaagcagatggttttgtcttattttattttgtctagcttttctagttgttctcagtggaaaggttggttcaaattaccttgtttgctactaactgaagtagaacccccagggatttttcaagccatgtggactattagaatccagaatgcatattgcctgctggtctcagaaaggatgtaaagaaaatggaagagtatccaccaggagagtgacacagtgctaaagtgagaaactgatcctctgaagaggaacaggagttatctctaaagtttcatctgaatctaaattttagtgactttgggatttccactttttagtttggaaaaaaactaaaaaggagagaaaactgtaatgtaagacaaaggtaagtcttgagccaatttgtccagatgattttattaaagaatgttaagaacagctgcaacaggtacttcctgtgtcaacagatcaattggtagctgctaattttttcttcaagccacagatacctaaagaaagttagagacactacctggagagggcttggtagagaaacagatcttgagggcatcaaagatttttctcttgagagtcactccccacccaactttggccatggtaggagtctgtacctgcctgatgaagagaaaaactaaatagagacatgagggactaattaaacaattatgtactttttgattaatccttagagagttgaaaggctttttcagtcatgatactagagaagattattagaaaaaggagtaaatcaaacaaaaaattcttgaaaattaaaaacaaggtttctgaaattaaccaaaaaaatgtaatggatagctaataacttgaatatgatgaagaccaaattgttgatctggaagatagagttgagaaaaaaaaagtccaataattatagcaaaaagaaacatgtaagaggagagtttcaagatatggaggtcagaatcagttggtccaaatcatttgacaggatctgaaaggagaggacagagactttggaggaaaagtaccaaagaaataatggaagaaaaattcccttagctaagaaagacagttgtttccagagtgcaagggcccaccaagtgtgagtaggttgaatggacacgttcgggggcattccataactacaagagaaaaagagggaatctttgaggtttccaaagataaaaacaagcaacctccaaaaagcaagaatcagacttctcatcgacaaaattggttgttagaatacagttgagcaatgtcttcaaagttctaggatgaaaaaaagaagtctgaacctagaattctacacccaaactgtcaatcaaaaataagagaatgaaggagggtagctttcagacatgtaaaaattcagaaagtttagcaccatgcagaccctgtaagaaggaagaaaaataacataaagatcaaacaaaacaaaatccagcaaaggggacagtgattgttataactcagaagaagtgaacaaagtcaaaaagaaaagatcttttatttggcaagatactcaagggttctcttctgactgacaaaatttaaatgacagtgtgttacatttccttttatattgctccaaccactttgcttggttctccagagaacagcattcatgcaatgatgttatattacaaatgctgcttactggtttttgtttttttgtttttgttttgtttttttttgggggggtgggttttttttttttttgagacagggtctcactctgcactgatcatgcagtggcacgatcataactcactgcagccttgacctccctaggctcaagtgatcctcccaccttagcctcccaagtagctagcatgtgtcaccacaccctgctaatttttgcttttttttttttttttaagagatgaggtttcaccatgttgcccaggctggtcttgaatttctgggctcaagccatctgcctgccttagcctcgcaaagtgctgggattacatgcctgagccactgcatccagtctgcttactggtttttaacacttagactcaatctatacacaaagcataaaaaatctacttattagttataaagtagaaagcaaatgttatatatctccagtataaagttaattataataaaaattgggaagaaaaaattggaaaaaagagacaggagtgtaaatgagttaaacgtaccatccttactaggaaggaaaagcctcagactaaagtttataaatcaagaaatgggggagaagtgtattatctaaagttgtaatgtaattaccagaacaactagagtgggatagaaagacttgatgttttattttgtcccatccaacaatttgaatatttaaaaacatatatatagcttactggttatatatatatatatatatgtatatgtatatacacatatttcttttctttttttgaagaagttgtcatggggccttctggagaggaggaagggggagcttgtctttggagtacctgaggtggagaactgaaaagcagtctctgagttcccctggcctcctgcgtatttgtcattctacagatctgagcctctgtcatcttctgagccaaagacacaagaaaactgacaggcctgtagggtctcttcccaaattggaggagcgcctggtctgcatctctccctgggaatgtggttcaaggacagcaaaggggagctggttccgcgtataaagagctccaggccgggcgcgttggctcacgcctgtaatcccagcattttgggaggccgaggcgagtggatcacgaagtcaagagatcgagaccatcctgaccaacatggtgaaaccctgtctctactaaaaatacaaaaattagctgggtatggtggcacgcgtctgtagtcccagctacttgggaggctgaggcaggagaattgcttgaatctgggaggcggaggttgcagtgagccaacatctcaccactgcactccagcctggcaacagagcgagactccgtctcaaaaaaacaaaacaaaaaacagagctccagccaggcctgcacatcctctttggttgagtaatttcaaactagaagcatgctccagtgtctcccttccatctcctcctctagagagagctgcttttctcttgtgctgctctaaatgaaaacagaaagtgaggggtgatgctcccagcagtcatcctgttaggtacagatggcggtggcatctcctcaactttctttgaagtctcttggccatccctgtagtggaagtggccatctgagaccccaccttttccacactgcttaggctgtaggtttcagaagtggtcccggctgtatcaaaatgtggctggtgcttcatggagcttcccacatagggctgtgcgtttggtagcgctgatattcaccaagtgacagacaagcaagataagctctctgcttatccgttgaccttcatgttagagcagtggacaagtttgcttcccaggggacatttggcaattttttgaagacattttttattgtcacaacttggagaggggagtaacggtgctactggcatctacagacagtccccaacttaagatgcttcaacttaggatctttcaactttacgatatagtgtgaaattgatctgcattcagtagaaaccatactttgagtacccatacaaccatcctgtttttcattttcagtacagtatgtaataaattacatgagatattcaatactttattataaaacaggctttgtgttagatgatgttgcccaactgtaggctaatgttagtgttctgagcacatttgatgtaacctgggctaagctgtgatgtttggtaggttaggtgtgttaaatgcatttttggcttatgatattttcaacctaatgggcttattgggatgtaactgcatcataagtcgaggggcatctgcagtgtgtagagatcagggatgctgctcaatatcctaccatacacagaatagccccccataacaaagaatgatctggccctaaatgtcaatagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaaacttccattcaacatgacaaagggagaagggggatctaatttctaattaatcaaatacacgtttgaactgaaaattgggaattaccaacctgagagttaacagttactatttaaggctgatagggcgtatcttactctttgattcaaactgttgcatgttacaagtatttcgtgtgttgtacgagtaaaatggggaaaagaaggtttttgtgggtggaatgtcgggcaattttttaagcacattttgttgtgtatatgttttctttgcagccatttttccttaattcacattttaaagttacctgaagcccatcctcacacacagtggtcccccactaaccaccacgctccccgcctggtgtggcttactagctcgatgtctgaccagtccccaggtgtacgatgtaagtactgcacatcagggttggagtcctggtcaccatgccagggtagtgtcttacgtaggaagaagaaaccatcatactcatgcctccaaatccacagatttttgcttctctaataagctgattagaaatggccatcttccatatgtttatagatttcgcatagtaacagagaaagcttttaccagggtaatgggattcccccacatcggccgctgtggtgtagtagaagaacactggatttggaatcagagccactggattggaatgcaacccctgacaggccatagatgtgctctgcatctcagttctttctctctctctttttttttttttttttttttttttttttttttttttttttgagacggagtctcactctgtcgcccaggctggagtgcagtggtacaatctcggctcactgcaacctatgcctcccgggttcaagcagttctctgcctcagcctcccaagtagctgggattacaggcgcctgccaccacaccgggctaatttttgtatttttagtagagacagggtttcaccatgttggccaggctggtcttgaactcctgacctcgtgatccacccacctcggcctcccaaagtactgggattacaggcgtgagccaccatgcccggcctgcatctcagttttctaatctataaaatgggcctagtagtacaggctggctgggagcattaaatgatgaaatacatgaagatacactgaaccacaaagcatgcaaggattccttttctaaatagtttatttatgttgatatggttaggtcctttctttccattttcagattatagaaatagactcagcacagtatgaaaagaacatgtacactggtggacgtcttagatttagggctgactcctgcactcctggtgtgggttgcagggtacagggcagagaggtagagagagcaaggtagctacccacgtggaaggagtagaggagaggtcagaggccttccttcatccctcttcggccatcctaatcatcttgtcactaacacagtcattatgccctagaagaaaagaatttctaaaatttgcgtacagctctagagttcacaaaggctaagttcattcgttgggtcataccatgaatcagtgagtactgcagcattacagagaaggaaagtgcatctcagagaggatgtgagttggccccgggcccacagttagtaattagctgggaccctcatgcaggtcttcacattcttagcaaataacctgcagtttacttgattggtgatgagaaggcagaacacaaagcctagatctgaaagagaacggccctaaacaggtaagttctaacgaggggtagcagggttaggaaaggcagtgcacattcatgtggtatagaggggaaagggatgtggacaccatagctaggtgggggcgctggggcggaagagaagggcagccacatcagagcagccgagattggaggatgcagctccttaaatggcacgctcttccttcaagaacagggatgacaactgccaagtcaccatgtgtcctaaacccgctgctgcagagagctctgtgtgtctgtcatccctaggccctcggacctctccttggccccctcagaggaaggtgaccattgaaaagtcctggtaggcagcgacagaactttacactgggaaactcagctgggctactgggtttcacccccttcacagcaggttctgcctggtaaaaatgtagttctgccacagccgttgcttggaaatttcaccaaatgtggcagtagcgttcatgtgtctttctcttaaagatagttgaacttccaacacccacggctcctccccatataaaaatgaaattcctgtgccacctgtgataaactggttttaaatgacaaaaaaatatgtaggatggtgagaacaccatttctgtagaactgctcccagtttgtaaagtgatgtctaatgcttgcggtaagttttaaatgtaatatctatcagcctaaataataatgctagttacctgttaggttagaaggacacaaaccaatagattaaaaacttagttttgtaatttctcatcctgctactagcttacttaagaaaagctgtcttgtgctgaatgctgaatggtttgctcagtttggcccgctgtctaaagtggtagtaggggccctttacatacatcatcggagacaaagggtgctgacggcatttccacttctcccactaatgaagccccaactgtgattacactttctgatcttaagtttcactgggtttatatatataaatttgtcttctaactctagtctcttctaaacactttgtaaaactttccatcttaattgggttttaataaggatcacttttcatgtctatgtaatagtaaaacaacaaatccactattaaaactttataaaaaccttatctaatctgaagcttactaaccagtcccttgctcatagattaggaatatctggactagtttgaactcagcataaactcagtaagcttacaattgcatcaatttcaagtgcttctcccagcagttcaagggaccactccaagtttgcttctgggggtcatgtttcagctgtgactccccacagccaacctaagactgagtgacttgggcttctagtgagaatcaccctcggtcctgctgctgctgctgctttgagccggggtcctgcctagggtctcagccagctccagacatggtggggcctgctgctgagacagtgggagcaaagggtctcttcaaaattatcagtggaggaacccaaaactgacagaggtgaaggggctcactgcaaagtttagtgcctggtgagggtctcagactgggcagttctcgtagattttgacacctgttgcatggttcttacccaccatctaaaaggtgttttctactttgccaagtttatttggagatttctaagatgttcatcagtcattatttccactaacgttaaaccacttaggtgtggtatccagcttcctaacaatgttctttcacttttgaaaatgacttctggttatttaaaatgcacacatccccacacactgttgtttgcaggtgttttcactgcattttcatagcagacttaattgcacagctagttacatgattatatagaccttcagcgtaacaaaacaaacttgtgttgatcctatcatctagaattcaagggagcaggttagttttatcatctgcatgtaacattattagactttgatgtcagaatcactctccatgggttgtttgttttttgagacagtctcgctctcttgcccaggctgcagtgcaatggtatcatcttgacccactgcaacctctgcctcccgggttcaagcgattctcgtgcctcagcctcccgagtagctgggattacagctgcgtgccactatgcctggctaatttttgtattttttgtagagacatggtttcaccatgttgagcaggctggtctcgaattcctgacctcaagtgatccgctcgcctcggcttcccaaagtactgggattacagatgtgagccaccatgcctggcctctccatgggtttttttttgttttcttttgttttgttttgttttttgagacagagtcttgctctgtcacccaggtgggagtgcagtggtgcaatcttggcttgctgcaacctctgcctccccaattcaagcaattctcctgcctcagcctcctgagtagctgggattacaggtgcccaccaccaccacccggctaatttttgtatttttaatagagatggggtttcaccacgttggccaggctggtctcgaacccctgacctcgtgatccaccctccttggcctcccaaagtgctgggattacaggcgtgagccaccgcacccagcctccgtgggttttactatggccttgtttctgaatgacctttccttgagtactatgtctgggcttgggagtttcagaaatgcaatgggttgacatccagtcttgttttctcctgtcagtgaatttaggccctgcttccctctgcaaagagtgaaagcggaccacatcacagttcatgcccagggtttcctctgtggtgctgtggtgggctttccttcatttgcggaattaccctcacctgcagttatcctgtgtttgcctctgtccttccatggctccaaaccttgaagcagtaaaatatgtgccaggaccatttccctgaaaactgggagccaagagccctggcagagagattttgacagagatgaacaaaatcattatgtagcacgtgtatgaatgggagaattgggatgtgccgagacagggaaggtgaactccccaggagttggaaattcggatgggagacataagctaccggctgggtgtggtgactcacgcctgtaatgccagcactttgggaggctgaggtgggaggatcacctgaggtcaggagtttgagactagcctgaccaacgtggtgaaattccatctctactaaaaatacaaaaattagctgggcatgatggtgggcacctgtaatcacagctactcaggaggctgaggcaggagaattgcttgaacctgggaggtggaggttgcagagagccaagattgcaccattgcactccagcctgggtggcaagagtgaaactccatctcaaaaaataaaaagaaaaagaaagaaggctactgtaaagcagattgagtttcgggactttctaaacactggtaaagaggaggaaatttgggagtttaaatcaagttttagaactgtgctctgagcatctgcctgaatataggacttttatctcattgggcatttgcaccctgcttcattccagtgaggatttgaagcagcaagtgagaggagttgcgtgcttgcctgtcaaaaatgctgaagcattagttaagtggagtcacagtgtagactgtgtgtagggaagttgacaacactgagaatgcagaaaacaagtatgtgattgttgccagtgagtgcacagaaataagtctgggagaggaaacgcaacccatgagtcttccctagctggtgcatttacctggcattcacttagcacctactgtgaggtaagcaccattgaggaaggtgccaaggtgtggagaaggaggtcactgccctttggcgtttgtcatctagatggggctgatctcggggaatctgcccatggccttgggcagtgtgactgcgcgggggccctgagggggtcagagaggccagttcggcgccctggaggctctgtctcataagaggatgcaggacttcagatgagctttgaagggtcggtgggaaacaggagagaaaaaatcagtttacccagcgtatttgacactgtgtttgcccttctagaaggcagtgcacagtactcaataggcctcagtgcagcgcgggagctgggttgtggccctccccttgttttgttggttaaatctattggaggaagaaggtcctgtctgacctcgtgccgtctccgacactctcgctaccatctgatagttcaagtggttgcaactttgctctccctcgatcatttgattcatccacctgaggatgtggcgggtgggcttcctatcagggttttcctgtggggagatgacaggggaaacagggaggaaatcctgattatggcttgtcctcttccctgaattgctgtctatgacaaagagtagttccaatgtaaacaagacgggttggagacggtttgtatagggcaggagacccacccggaatgcctacccagagaagacagtacctgaaacctatttgcaacgtttgcccaattaccctactctggccttgctttgtgtgttgattgggaagctggaaatccaggctggtctccctttcttccctttttcactaaccccaagctgtcagacattgaaattagaaactgttttctagtattctaagtcctagtcctggcaaccgtgcccggccctctacagtttacatccagttaccacgctagaggctcaaggcaggcaagtttcatagtccccagttttcagatgaggagttgggattgggattggggttggtgccaaacctggaagatatcagtctctcatttttgttgttgttgttggttgcacttttcagaaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatc

SEQ ID NO: 3369 - DNA, 153737 bp, human
gaggaggcgcggggggccccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatggtgagcacccctgttacaccccccgccctccacacccctcggccgccgcgctcctcctggcgccgcgcggtgctcccccttcacttgccaacgtgttccgtttcttttacgtttcccgctgcgacggtgttggttcccaaggtcaactgtctgcattttctggctctctgctaccgttaaaaacaattccacccctattccacgtttctgcattgggaacccaggaaaatgaaagggacagaggtggtccggttccgtctgccccgttcggtctctgttgcaaacctcttacccaccacctcccgctccagttgagctcgatagggtgtgtgtgcctgcgtggtggctggaggtgggtggcttcccaggtgactgcatcacctcaggggacaggccacagtagggagtggggacgaagtctgaaagtgtctttgcttgggtatgggttagtggggcctcttggacgccacatccatggtcagcctgggtgggtacccactcctgaggtccacattcccaggtctcttaatgataaagtcagagcatgaagtgtggtgaaaggtgagcagtggtccaggacccagagtgggtggcaccaccatgtcaggcctggacgaggagacaggcacgcctcctgctcttatgtcccgagtggaaagttatacccagttacttgctttctcaaacgaagaggagcttttgtattcctaagacggtaacagggagtgagtttgagatacatttccgaatgtatgaaggggaaaagtcgtggttttaattccggagtcagccatcttttgttgttaggggtgggctgatgctaccatccttttctagatttaatggtacacagtgtgttacatgcacagtggtcagtacaaatctccctttattacatggatgtcagccataatctgagtcatccctcttcctcttctgtgccccctgcctcccccctcgccctgcccatgactccaaagtggagtcaggtattctctttttgaatgtaattcagtggtgttaaagcccctgaattggcatcctcacacgaaatagacgagccacttcatgattgttcccaacggggaaaattttattttatcacatatactgagggatttctttattcagtttccatccaggtgccctgatagagaatggaaagcagaaaccttaacctttaatgtgaaaattacccttggttctgggccttgcttctcatgtttcttgattagttgttgacagccggggctcatggccaccaggccctcgcagccaaaccgtgtaaggggcaagcgctgttaagagccctccagttttgatgaagtagtgacctacacagatcttgaaacaggaccaggtctaaaaccgagtttggtgattgcgaattataggtctcaacacagactttggcctccatccctgaccgttgttgagctctgtggtttgtgtcagttggtgataaatgactgatgccaggcctgcaggtaagctgggaggtttcctgagaagacagacaggggggaattgaagcacgtggtcattgcaggtgattgactccaagccatgatgcaaatgaaaattgcctttatatagataaccgtgaaaatatttttatttaataggccctagacccagtttcttaaaggacaatgtgaaataggaggtagatttgtcagattcgtaaacacatgctcaagggatggaaaataaatggggatttgaaaatatattttctggagagtactccgtgttctgaggagttcaatcacctttatcttaaggcttaaagacaacagtggaattttcctttgctgatacgtacttttaaaactcacctccatctttcagccatttggttgtgctacagtgtactgttttattttgtgaacaatcaagttacaaatctagtgtaactgatggctgttcagaaaaggcaatatcatctcagcattcctgtgtaattttgttctatatctttgagtattagtgtttctttaaatgtataaagaaatttagtttgtcaatatgtgatgtctcaggttatgccaaatattaatattttaaggactgtctgtaattgtgagaaaacatttcttctttctctcaggtatgtttggtcttctactgcaaggtccccctaatctgaattctaatgtcatgtgattagctaattattcatagtatactgaagactattgggatggggattttaaactgatcttaaaattcagtttgcaaatcttttaaaaaattgtctgcatttaagatgtacaacatgatgttttgataaacacaatgaaatgattactactgtcaagcaaatctttgaacacaagtaaatccagtaaagatttttcaagacttctcttttttaatagtaaaaaataaaatttgatttctctatatcaatagaggaagtgagtaattgtcctcttggctctgaataaggaacgacaaaaagacctaaggaaacatttttaaagtatccactgtgtgctgggaacccaacttaatttctggaggcaaacaatttaacttttaaatgtttatgaatgaaagagttcaactgtgaatttcaaaactctttattttgagaaaaagttttaaaatgtaatttctgccacctttttgtgtttaagtgacactttaatctgagaagaacagcgtttacatttaagataaatttatatatatataaatttatatatttgttggtatagtcgtaaaatatctctggaaggacatgcaatagatgagtaacattggtttccttgggggagaggaactagatggctgtgaaataggagtgggagggagaggtcaccatataaccttgtatgcttcttggtcttgtaatagcttttttttttttttttttccaagacggagtctcactctgtcgcccaggcttgaatgcagtagcgcaatctcggctcactgcaaactccacctcccggattcaagcaattcttcatctcagcctcctgagtagctgggattacaggcgcccgccaccatgcccggctaaattttgtatttttagtagagattgggtttcaccatcttggccaggctggtcttgaactcctgacctccacccacctcagcctcccaaagtgctgggattacaggtgtgagccaccgcacccggctgtaatagcattttaacgtgctcctcaaatcactcaatttgacgcctacttctccctatttaaatcacattatgttatcaattttcttcatgacttttcaattcttaattgtgcccttggagcttttctgagccctgtgtctgggatggagataaaatggggaaaggggaagagatttctctctctctctccctccctccctccctctctcaccctctctttcccactcgctctctccctctttttccttccctttattccattatcctcagagagtagtcaatgttacattagcagtgatgtgcacaaatagaccccataataagtgcttgcttggatgcagaggacctaaggaaaataaaagacacactgtgaatgcttaacgtttaaacagaaaggaactcccccacccaccaaaggacacttataagcattcctccctgacaggccagggcagctacaagggaaggtagctacagacctaactccccaggaaggttgaaagcagcccccagaccccaccactggagctgcaaggcagcggggccaggcacttgcctgccaccagtctaacctgttttgtcaggccagggagctcccagctgtctgtctctgttatgtgattaagtgccatcctaaagttactgggccctacatgtctttgcagcagaaatagaaagtgtttagggcagggaaagttggtataaacagactgtgccagttcattgtggttctctctcagatgtacggtagttccacttcccccataatgtttttgtgacaactgatatggatccaaaataatctgactctgccatgctaacccaccacctgcttctcgcttcctcctcctccaccaccccatcacctttccaaaaatatgttgatcagcccctctaggttctatgggttgtgggctcactgttgctgtggtggagctggattgctaagcacagcctgagagtgggctcataggcagagtctgaaggggaaaaagatgactctttgcggtaacatgaaattaacatttgaacctgtaagcaaacattttggaaccatctccttcctggttaatcaggagtccccccttttaagagcccctcactttggccccagttgggagcagcttctgtatggtctcactttggtaccagataaccctgggttcaaatgctggccctgttgcttataaaactgtatagcattggataaactctctgagccttagcttcctcttttggaaaatggagattatgttacctcacagaattgctgtgttattgagatattctaaagggtcaagtgcagtgtctgacacttaagcacttggtaaatattagttcccattctcattttaggctttgtgattctttggcaggctttactacttgaggtttgttcagtagtggactgttgtaattttaaaatgcattaggacacagttagtggaagtgaggaaaattgtatattttggggtgagcttttggttaatacctagaaaaaaatttacaacacacctacccttttaaaattttatttattattattattattattattatttgagacagagtctcactctgtcgcccaggctggagtgcagtggtgcgatctctgctcactgcaagctccgcctcctgggttcatgccattctcctgcctcagcctccagagtagctgggactacaggcacccgccaccatgcccggctaattcctttttgtatttttagtagagacggggtttcaccatgttagccaggatggtctcagtctcctgaccttgtgatccgcccgcctcagcctcccaaaatgctgggattacaggcatgagccaccgtgcccggcccacacctactcttttattcagcattttcaattcttggactttcagaaatctatcagaaatacttgtgctagcatgttgcaatatatagacagcaatatttgttgcagtggacataagttgcagaactcatcagatgagactggttaaattgtagcacattcccattaaggaatactatgcagcgataaaaagaggtgttttgagatgtccttttaaggctactgtccacacataatgttgtggaaaaaaagcaaggcacagaacatcatgtatagtattattctatttgatctttcaataactatatactgtatatacacaaacatgatgtatgtaatttatatatgatatatgtgcttttatggaaggatatgcaagctttatcctttgggagcaggatgagttgttgggagagagagaggggaggtggtacttttcctttatattattctaaatggcctgaactttctttaatactgacacattacttttgcaatttaaacattatttaaaaatgaagcaaataacttatgtagcaaaaaaatgctttataaacagaagattgtactatgtggttacatagcattttccttggattgtcgaaatgttctttgtaaagcggtctctggatataaagaatacttttacttattatttgaaagttataaatggaagtaaaatgtttgtatcttaaaaaatagaaaaatgacatttactaaaagcatttcttagaatattaaaaagttaacctttgtggaacgctgtaattagaaaaatcacaatttttcaacctctagtgatagtttatttagacaagggttttcaatgaattccagaatcctaggtgaaaggttattggggaacatggtacttgcaaagtactatcaccccacaggttacttgcctgttgcaaagaaaagaaggtacctttacagtgaagaggtctggcagtcaccatcttataagcaagtcatcaaatgtatccttgctcattgtgggactatctagtatcatggtatacaggaagtgtacagctttacctatgtagtatccttcctgtatgtgtttaatctgaatcaaatcaaggacttagacacatcttccagtttccaggaaatgcagaggatagagaaacaagttataaaacaccatgagaaaacaatcagataaatccaatatatgggatgatctgtaagacagttgccccagactcttcaaaaagtcaacgtcaaaggaaacaaaaaggcagggtgagtgttctagattaagggaggtcaaagagactaaatgtagtacgagaaacttgattggctcctagttcatgaaaatgaattataaaagatgttttggggataggtagggatatttgaatgtagactgggtattagatgatattaaagaattactattattttttgtaggtgtgataattgaggttatgcaggagaatgtactcattctttggagatgcaagctgaagtattcaggggtaaagtatatgaatcctaacatatgcaactttcaaaaagttcagtaaaaaaatatacataccacctatatagagaaaacaaatattgcagcctactagctaactgttaaatgtaggtgcctagtgaaagggtatgctttatatactcttctttcaacttttctgtatgttttgacattgtcattaagatgaaagattggaaaagaagttaatccccctcttagcttgcaacctattaacttccctgcctggaagattgtacaggtgaggctgtacacatcctgtctgttactctcattaaactctttctagcactgattaacactgtttgacattagtttacctgaggtgaagttaggcttacgtgacttgagaatcagtaacttctttcttctttttttttgagacagggtctcactgtgtcatgcaggctggagtacagtggtgtaatcctagctcactgtagcctggacttcctgggctcaagtgatcctcccacctcagcctcctgagtagctgggactacaggtgctcaccactacgcctggctaattttttggtattttttgtagagacagggtttcgccatgttgcccaggctgatttcgaactcctgcgctcaagccatccacctgcctcggcttcctaaaatgctgagattacaggcatgagctgctgcacctggccagtaacttctttttcattttactttttgtttgattcttaagttcatgtattttttaaattgcctctgtttaacatacaagagaatatgtgttaggagaattttctcttttagttaaagcatgctacctggcttttaatcaatatgggtatttatattagagtaatactagatgttaaaacaaaccaaccccaaatttcagtgacttaacataggagaaatttgtttttcacgcatgtaatggaccagtgcaagggactggcaggtggctgtctctacgttgtgattcagggaccagatgccttccatcttgtggcttccccatcccatatggccttggaatcctcctcctccagttgatgaatgaagcaaggaaatgaagatcatatggggaagacttatgtgctaagcctggaaatgttctgcatcactttgcccacttctgttggacagaacttggttacaaggccacatctaactggaagggagccagggaaacatagtctagttggaagaagaggaacaggtttggaaagcagctagccaatctctattgcagtatttgatgagtactttgttatacataatccagaaaagagaagtaataggatttgcatgtgatttgtgtgtaccacagtttacatacaaatgtaaaggacactgaaggacatcttggttgcttccaagtttgggcaattatgaataagaatatttaagttttcacccttcaaaaacattcactatgttgtttctaataaaataatagtagaaaaaaatagtaactgtttattgagcacctgttagaatagtctgtcaccgtgttaagtactttgcatacgttaagccatttaaccttcacatcaaatgtatgaagatcaggctgggtgtggtggctcatgcctgtaattctagcactttgggaggccgaagcgggaggattgcttgagcccaggagttgaagaccagcctgggcaacgtggcaaaaccctgtctctattaaaaatataaaaattagctgggcatggtggcatgtccctgtagtctcagctacttgggaggctgaggctgatggaggattgcttgagcctgggaggtcaaggctgcagtgagctgtcattgcagcaatgcactccagtttgggcaacagagtgagaccctgtctccaaaaaataaaaatgtttgaagatcctaatattggtcccattttcccaggtaaagaaattgaaacctaggtcaagtacctcctttgtttaaggtcacatgtttgaaattgggaaattgggatctattaaaggatgaactcaatatagctgaggatgtatttggccaggatagagcagaacctgaatcccgcccattaccacttcctaggaggtctctgagggaaatctatgcccagagtagaaaacaaagcaaagttgaccctttttttttcttttttctttttgagacagagtcttgctctgtcccccaggctggagtgtagtggcacggtctctgctcattgcaacctccgcctcctgggttcaagcgattctcctacctcagcctcccgactagctgggattacaggcatgctccaccacgcctggctaatttttgtacttttagtagagacggggtttcacgatgttggccaggctggtctcaaactcctgacctcaagtgatctgcccacctcggcctcccaaagtgctgggattacaggtgtgactactgtgcctgacccaaagttgactcttttatgttagctaggacttttgctctcaagctccagtgtagaacagtgaggaatgaggcaggatgacaaggaaaacttagttttcctgtgctagatcagcctgggggccttggatccaagtaggagcaaaatgcctgctcctttcagcccaaaggtcacactccaggtgttattccattgatatgacagaaggctaccagtgttttaggggaaaaaatgttaagagctgttcagagtggcagcaccaggccttcgtacatgagagtagttgcttgaaagcattctcatctctagacctcactatcagagaggtggggaggcggatagggttgggtctgtgcagctctcatgtctctccactctatgctagttgtgatgggcatatcagaatcttctggagagcttttccaaaatgcattagaatgtaagccctgggcagacagagatatctatcttttgtttgtgctgtctccccagaccctagaacagtgcctgacacctagtagatgctccagaagtgtttgtttagtgcattctattttgtctatcaaaaaataagatgctataacgctacctagcattaaaggtccttccttcaagttcttccctcccctcctccttcaagttcttatgcctcagcttcacactgacagtgaagtttctgagaaggaaacctttgtgtgtgaaaacatttgcctgaattgcagcagactgtttaaggaaggaggatgaaggaataaatgagtacacaaataatgtgtgtttgcagaaaagtatgtgtttggctgataagtcacgtggtagttgtttattttttttttggtaaaatatacataacataaaacttgccgttttatccatttttaactgtataatttaataacatttataatattcacaaagttttatggccatctccactatttccaaagattttttattgccccaaacagaaactcttccagttaagtagtaactccccatccacccttccttctagcccctaatagtctctaatctaccttctgactttatgaatttgcctattctagatcattcatataagtgaattcatataatatttgtcttttgtgtctggcttatttcatttggcataatgttttcaaggttcatccatgttgtatagcccatatatgaacttcattcctttctgtggctgaataatactgcagtgtgtgtgtgtgtgtgtgtgtgtgtgtacacgcacacacacacacacactccacatttatctgttcatcagttggtggacactcgggttatttccaccttttgaataatgctactatgaacactcacatagaggtatgtgttagagtccctgttttgttttccttccttctgtctgtccttccttccttccttccttccttccttccttccttccttccttccttcctttctttcttttttttttttttgacagagtttcactcttgttgcccaggccggagtgcaatggcgcaatctcggctcactgcaacttctgcctcccaggttcaagcagttctcctgcctcatcctcccaagtagctgggattacaggcatgtgccaccacgcccagctaattttgtatttttagtagagatggggtttcatcatgttagtcaggctggtctcgaactcctgacttcaggtgattcacccacctcggcctcccaaagtgctgggattacaggcatgagccactgtacctggccatttgttttcattccttttggctgtatacctaggagtggaattgctaggtcatatggtaattctatgtttgactttttgaggaaccaccaaactgttttccacagtagctgtaccattttgtattcccaccacaatgcacaaagattctaatttgtccacatcctcttcaacacttgttgttttccatttaaaaaaaaatgatagccaccctagtaggtgtgaagtggtatcttgttgtggctttgacttgtattcccctaatgacttatttgtatttcccttcatgtactttttggctatctgtatattttatttggagaaatgtctattcaaattctttgccatttttaatcagggtttttttgtcattgagttataggaattctttatatattctgaatattaatctctgcctccttccattatattgtcattgtcaaagagcagatatttatatattgtgtgctcattaacataggtttataattttttttgcatttgcttttttaatcatgtaggaaaaatgaggagtttgaaacccaaattgttatgtttacctgtttttttaaaaacaatattattttgtttataaacgaattatttcatgttgctttattttaaaacaatttaaaaattgatgcataatagatgtacatagttttgaggtatgttataatttaataaatttgtataatttgtgaagattaaatcagtatatttgagatgcccatcaccttaaatatttgtcttttctatatgctagaaacatttgcattattcccttctagctatttcaaaatgcacagagattattgtaaactgtggtcaccctactgatctaccaaacactaggctttgtttcttccaccaaactgtatatgtgtactcattaatcactttctcttcgtccctcctccctacccttcctggcctctggtaacaactagtctactctttatcttcataaaatccacttttctggcccccacatatgagtgagagcatgtgatatttatctttctgtgcctggcttatttcacttaacataatgacctccagttccatccatcctactgtgagcaagaggatttcattcttttttatggctgaataatattccattgtgtatatataccacattttctttattcattcgtccattaatgggcacttaggttgattccatattttggttattgtgaacaatgctgcaacaaacacaggagtgcacatgtttctttattatattgatttcctttgttttgggtatatacccagtaagtggaattgctagatcatgtggttgttctagttttagttcttgaggaacctccaaactgttctccatagtgattgtattaatatacattcccaccaactgtgtatgagggttcccctttctccacatccatgttgtcatctgttgttgcctgtcttcttgataaaagccgttttaactggggtgagatgatataaaattgtagttcttatttgcattcctctgatgattagtgatgttgagcattttttcatatgctggttggccatttatatgtcttcttttgagaaatgtttatttaaatcttttgctcatttttaataggattttttttttgctgttaagttgtttgagctccttatatattctggttattaatctcttgttggatggatagtttgcaattattttttcccattctgtgcactgttttttgtttgtttgtttgtttgttttgagatggtgtctcgctctgtcgcccagcctggagtgcagtggcaccatctctgcttactgcaacctctgcctcccgggttcaagcgattctcctgcctcagcctcccgagtagctgggattacaggtgcccaccaccacgcccaactaattttttttttgtattttcagtagaaatagggttttgcatgttgaccaggctggtctcaaactcctgacctcaagagatctgcccaccttggcctcccaaagtgctgggattacaggcgtgagccactgcgcccgacctgttttttttttcttgattgtttcctttgctgtagtacatttttcatttaagttactgtactttttggcttcagaattctaatgcttcttttttataatttctgtctctttactgatattcttattttgttcatacattgttttcctggcttcctttatttatttgtctgtggtttcctttagtttttttttttttttaatagagacagggtctctgtcacccaggctggagtgcagtggtgtaattgcagctcactataaccttgaactcctgggctcaagtgatccttctgcctcagtttcccaagtagataggactacaggcacataccaccatgtttggctaattaaaaattttttttttatagagacaagtgcttactatgttgcctaggctggtcttggactcctggccttaagcaatcctcctgcctcagcctaccaaagtgttgggattacaggcgtgagccactgcctttcattcattaagcatatttaagacagctgatttaaagttttcatctcatatatccagtgtctcagcctcctcagggatagtttctatcaatttttttcctttgaatggcccatacttttcctcccaggtagctgcagggtgtttttgttagtttgtttgtttggcctaccttacaacatttttcaagcaatgcttgctgcttgtccgctatgagtgggctccaagttaggcaaaatggagatgagaacctcaagtcattcctttgggtagtcttcagacaggttagaacaaacacaaaaaattgcaaacaagccctgctctgctccatctggaaccagggaccaggggatattggctgctgtgttcaagaccactgctgagctggtgagggggtgggacaagggcaagcaaaatgccacacagccttcctgccattttaaagttgccttgttcttgagtcattgttcacttggttgctgtaaacctttgactctcttctagaattctgacaaaattggctctgacagcttctgcttgtttttcaatgtttctgtggaggaatgggagtttggagctgtctactctgctattttgctacacagccttcctaccattttaaagttgtcttgttcttgagtcattgttcacttggttgctgtaaacctttgactcttttctagaattctgacaaaattggctctgacagcttctggttgttcttcaatgtttctgtggagggatgggactttggagctgtctactctgctattttgctaatgctctttaccaaacacggtatttttaaaaaattaagattctgtatatcttcagagacactgcaacctttggggaagaacagtgttaagcgctatgttttgttaaacttaacatgttactgagatagtaaatgtcccagaggtagtctttcaaattgtatcataggctcttatcacatattttcactgagaagctagagatcgagaaacatctaactagtgtgtaacttcaggttcatagtcaacaaattttctccttttacttcttcatatctacccctaaaactaattttaggtaaagacacatttacttcaaattgtcttgggttattaaaaggattgattctcagattacttttgttgagtgtagaatgaacgaggtgtagcagactccagttacctcccaatatccattgttcctttcattgttccagtagaaccctgttctaattagctcagcatattgctgtgcaataagaaaactacatttcctggcctgtcttgcagctgggtgtagttatgtgatcaagttctggccaaaggtaggaggagaagtatgtgggatttatgcaaagtattcttaaaggaaaggggcgtgcccctcttctaccatgccttctgtctgcttcctggaatgtggatgtaatggctagagctccagcagctgtatttggtcaagaggtaaccgtgggaatggagaacacttctggcaatacaataaaatagatgacgctgtagtctctgatagcatagagctgccatgccagatttggactgaatacttatgtatttcttataagtaagagagaaatgggtttttgttatttgctgctgaacctgaatgtaacttttacatcaggcactgagttgcacttggaacttgggtgtgacatacagggctgttttgaggacttggtgcagatgttcgtacctatgatgaatgtggcactgcttgggattctaggggaggccaaagagtagacagtacagggccagagaaaggatttgaggaaaagattcagatttaaagtgttgcttatatttgggaactttggggcatctaacaactacccatgcatttgatgatgtgccagaaagactcacaggatccagagacagttgtattaaagccatgacttattacagtgaaaacatacacagcaagatcagcaggagaaaaagacataatgggtggagcctgaaagagtaaatgtgagcttcctaagttctcccttaggaggttgggggtggggctgcatagaacaaactttttccacctgcaattaaatgtagcggcacatatgcagtgtttctgtttagggaagcttgcttaagacacaggcttttctgtattgagggctgatcaggcgttcttattgaaatttctgagtttcagaaggaaagcaggtgttcaccataaatcacatttgcaaaagcaatttagcctggctggtacagcagaattcagtgttccaggcacacaaaacaaccttatcaattagtagcataggtaatatctcacaggccaagttcccaggacctattggaatatgaggtcatgcaggcatgccctcctagagatagcaacatcaggcctgttatattaactttttcctgcagagtaatatgtggtgtcaactggctgttagctttttgtgttcttgaggcttcctcagtttcatccacactcttatttttttcatcattacctttttaggctcattaattttttttttttgagatggggtctcactgtgtcacccaggctggagtgcagtagcatgatcacagctcactgcagcctcacactcctggattcaagtgatctcctgcctcagcctcctgagtagttgggattacaggtgcatgccaccacgcccggctaatttttaagaactttttgtagagataggatctcactgtgttgctcaggctggtcttgaatgcctgggctcaagtgatcctcccaccttggcctcccaatgtgttgggattataggcatgagccacaacacctggtcagatttattaatttaatttttaacattatcacaagtaaaattgactttttacttttgatatacagttttatgaattttaacatatagatagatagatatgtgtaaccaccaccacaaccaagatgaagacttgttccagtgtaaaaaactctcttgtactaccacatcacttggacaaccactgatctagtctccatcactgtaattttgtcttttcaaatatgtcatataaatggaattgtacagtatgtaacattttgggactagccttttcactcttcataatgccttggagattcacccttgttgttgcatgtatctataattaggtctttttttttttctctgtgggattccattttatgaatgtatcacagtttatttgccagttgaagaacactaggcttgtttcgagtttttgataattatgaatagggctgctataaacattactgtacaggtttttgtatgaatgtaagtttttatttttctatggtaaatacccaggaatgggattgctgggtcagagggtaggcatatgtttaactttataagaaacctgccgaactgttttctagggcaactgtacattccatctagcaacatgtaagagtttagtgctccacattctctttagaactcggtattgttagcatttttaattttagctattctaatagatgaatagcagtatctcattgtggttttaatttatatttccctaatgttgaatatattttcatgtgcttatttgtcatttatatatcctttttggtgaaatgactgagtcttttgcccatttttaaattgtactgttgtttttctttggagtttcgagtgttctttatatactttgatggaagtacttcattagatgtgtaatttgcaaatattctctcctagctttggggttttttttttcttttcagtatcttaaccatatcttttggagagcaaaacttttaaatttcgatgcagtccaatttatcaacttttatttatcatgcttttggtgtcatgtccaaaactatataatcccaggttgagaagattttctcctatgttttctcctaaatgttttatggttttgcattttatatttagatctatgatttattttgagttaatgtttgtagaaggtatgaggtttaggttgagtttttttatgtatagatgttcaattgttccaatatttttgatgttcttttgttccaaaagattgttgttgacaatcttttcttcactgaattactgtcacaacattgtcaaaaatcaattgtccatatttgtgtggatctatttccggactttctattttattccactgatctgtgtatctagctctttgccaataccacaccatctttcttactgcagttttatagaaggtcttaaaattgggtagtgtgaatcctccaaccttactctttctcaaaattgttttagctgttctagttcctttgcctttccatatacattttagagtcaggttgtctctacctgcggaatgtcttgctggtactttgattggaattgtattgaatctgttagtcaatttgaggagaatggacattattactgtattggattttctgatccatgatcattatatttctctgcttaggacttctttatctcaaaaatgttttatagtttcaatgtacaggtcttacatatatttaatggacttatccttaagtatttcacatttgtgatggtattacatttgatattattttcataatttcaatttccagttgttcattgctaatatatagaaatacaattaatttttatgtatgagtcttgtatcctgtaacctcactaaactcacttgttcgttttagtagctttttttttttttgcttatttcatacatagacaatcatgtcatctgtgaataaggacagttttatttccttctttgcaatctggatgactttgattccctttttcttgcctaattgcattggttagaacctctagtacagtgttgaattagaagtggtagggccatagtggacatccctatcctgttactgatttttggggaaagcaaagtttttcaccattaaagctagctgtaggttttatttgtttgtggctattgtaagtggggttgccttcttgatttctttttctgctagttcattataatgtatacatatacatatacaatgtatatattacaatatatggtcgatatatagaaatgctactgctttttaatgctgattttgtatcctgcaaataaattgaatttgtttatatctaagagttttttggtggaatctttaggtttttctaaatataagattatgtcatttgccaagagggataatttgactttttttccaatttggatgccttttatttatttctcttttctgattgctctggtcaggaatttcagtacaatgttgaataggaatggcgaaagtgggcatccttgtcttgttccagttcttagaggaaaggctttcagcttttccccattcagtatgatgttagttgtgggtttgtcatatatggcctttagggaagctttaattttataaacgtgttttgatctttcttgttattgtaatccccatatacatacactctgtcctttggtatttatttttcttgaactgtggacttcgtgtgtgtgtctgtatgtttatacagttaagtatatgtaaatgtgtttaaatacacatttaaaacaagtctaccatggactatctttttctagtctaggactctgttgactgctgtacatttttgctgctgagagaactagggggaaagaaaagattgcattcattaatagagtgggctatgaatgagccagaatgattctccccagtggtatgaataagacaattgtctattttcaatggcagtgttatgctgagtgtttatgatggctctgaagagagacagacaagatggtgatactgtagtgatttttatccattgtgggaaaatctggtaaagagtcaaggtctgttatagcagatgaagtcctcccagcaaagttggggaaaaagagacaggtagttcagtaggagacaactgtttaccaaggcattggaagagctgagaagccaaacagagtgtgttgaagcaagctaaagatgagcaacagcagaaagctactttcatccctggggctgacacagggagaaggtagtattaccagagcccaggaatgaggttgcctggcaagaacaactattgtgagggctgttgggacctggtcggagggctgtctgatgggagcttcagccatggagaacacatagccaccaccagagagagagagagagagagatgataggagtcactccttaccctgtgacatgtgcagagcaagaaagggcataaaatggatccaagggccaagactagcatgaagattcttcttcagattgaatacctattctggtgtgtagtatatccaatacctacatacaatatggaagggaggaaaaaaactgtgtggtcagggtcaagaagaactaatatgtctgtcaccaaactcagggggaaaggaaatcaggtatcgaggcacaagctggaactgctgtggtaatatatgcctgaaggatgggatgaggtaattatgacaaatttctcatttaaaatattaagcatatgtgttaaaaaacctcacatcagctattttgtaagcttatctgtcgttgttttattgaattattatatattatttagggagaggaagtggcggtagatatggagatagaaggaagaacactttttatagtgtaagtaatgttgtaatttaatatacacattaatctttgtaggcacaatggtaggtatttctgtaacaatgccttttttcagagagccacattaacagtgataccctggtatctccaggaccgtttttgatgagtttagccagagaaactgtgcccggggtgggtactaatctctctgaatcaatgctatttggtgtttgtttgtttgttttgttttttttttttgagatggagtcttgctctgtcgcccaggctggagtggagtggcatgatctcagctcattgcaacctttgcctcctgggctcaagcgattcttctttctcaacctcccgagtagctgggactacaggcacgtgccaccacacctggctaatttttgtatttttagtagagatgaggttttgccacgttggccaggctggtctcgaactcctgacttcaggtgatccacccaccttggcctcccaaagtactgggattacaggcatgagccaccatgccaggcaatgctatttggttttatagtaatgtttcttcaatttctataattcaggcagttcttgaaaaattcctaaatagagttgggtttccgtaaaagaggacatttccacaggagtcctgtaattaagcccttgctggtgtggagggcttggtctggccagtgacacaaggtcaagggatgatgtaaatttgagaagttttttctgcctcaaaaggccaaatggacatcaagcatttatgtgttacaagaacatataagttaacgaaaacaagttctgtctttgaattatagcaactcaggtgagactattagttatttcaaattgatcacaattcttgattgaatgttaatactatagatgtccaaacttttcttttcttttctctttctttctttctttctttctttctttctttctttctttctttctttctttctttctttctttctttctttcttttttttgagacagggtctcactctgtttcctaggctagagtgcagtggtgtgatctctgctcactgcagcctccacctcctgggctcaagtgatcctcccacctcagcctcccaagtagctgggactataggtgcatgccaccacacttgctagtttttttttaattttgtagagatgaggtctcactatattgcccaggctggtctcgaatttctgggctcaagtgattctcccacctcagtctcccaaagtgctggaattacgggcatgagccactgcacccagccccaaactttctgtgtatgactgattagcaaaatattcagtgagttattacctaatgcattgtaatttgcttgatgcaatctttcagtatttcaaatatccagtccttgtgggaaaaggctgataaaactggaaatactaataaacagacttctggtttcagcctagatatgtggcatgcagagctgtcatcattacaaaaagaaaaagctggacaaatggaaaattaataacttttcctgaacctaggaaagaaatggagatttcagggcaaatgattaacccaaaatcaggagagagacaggtaccactgaagaaagaaacaggacctgaacatttgcttacttgggacagatactgttgaatggcatataaaccagtaagaagattaaaccagaaatttgtaatgaattgctcaaagttgggggccacagatatagggatttcttgccctcttacaggcttttcctccaggattcctgccaaatactcacagggaagatcagggagaatcctgagaaagtttttcctgtgtcttggctggggtagaagaacaaaagccactgccaaaatctgcctagatatctctccatctccctaaggaacaaaagtcttaatctgcaggaagaaagtaacagaaagtgagactactggtggaaacccactgtaattggggaaggagaagaggaaaaagaaagaagatctactttcttgggaaaggaaatgaatgcctggtaggcctggcattgtgtttggaggaggatcaggaatgcttatgaaggccacaaccccaagacccaggttcacagtatctgcataatattgcaaattaatcagaatatcagaatacccccatttctcacctccttactataaagctaacaagcatcaaataaaaataacaatggaataaggcctggggagctgcaagagagagattgtctctggggagcagtacaaaaacttaaaagtcaagtatggagacccaaagccaagcgaggggaagacattgagaaaaatcttgtggcaaattacccaatgccataaaaacaagctatcagtacaggaatatgaaggctcctgaggccctgagcataaccatggaaacaataatcttcaaacctagcccacctcctgattacattaatacaaacctcaatgctaaaggcctatcagaaaaaaaggtgtactcatcttcaagtataaaaaatatttacctcagtaccattttgatacaaaatatctgaccatcagaaatacattacaagaccaaaaaggcaagaaaaggcaagagacaaagcagtcaccagaaccaggctcatgtatgacacagatgttggaactatcagagaatttttttttaaactatgattaatatttttgaagctctaatggaaaaagtagataacatgcaagatcagataagtaattttaggacagagatggaaaataaaagaaaaaatcaaattcaaatgctagaaacaaaaaatacagtaacaaatgaagtggactgtggactgtaagagtcaatgaacttaaagatattggaaggcaaagggtgaaatgatcagaacagaatatccaagagaagagtaacaatgtcaaatggtctaacattcacataattggaatcttgggaggaagagagagaatgagaatgggacagaaatattagaagaagtaatagctgagagttttccaaaattagtgacagatgccaaaccacagatccaagaactttagagaacaccaagcaagataaataccaaaacaataaacagatacccaggcatatcacatttgaactgcttaaaactaaagacaaggtgtctgggtgcggggagagggcagggggaggagtagaggaggaagtgctatatacagaggaaaaggataagaaatacagcagacttttcagtaaaagaccatacaagcaagaagacagtggggtggcttgtttcaagtgttgacagaagaaattgtcaacccagaattctatatccagtgaaaatgtccttcacaaatgaagaagaaaaaagactttttgagacaaacaaaaactgagggaatttattgccagcagacccactctacaagaaacgttaaaggaaattcttcaggcagaaaaaagtgatataatttggaaaactggatctacaaaaagaatcaaagaatgtcagaaatgaagtaagtgaagatgaaatcttttaaacatttagttgttctaaaaataagtgatttttaaaaaataaaatttataacaatgtgttgtgtgtttatagcatatgtaaaagtgaaatgtatgacaacaatggcacaaagatggaagggaggaattggtaaaatactgttataaggtcctatgctccttgtgaagtggctatattatttgaactcagattatttaaaaacattgtaaaccctaggataactatttaaaaagtttaaaaagaggtataaataataagtcaatagaggtgataaattgaataataaaaaatgctcaataaaacccagagaaagcagaaaaaagaggaaaaaaggaacaaattgatcaaatagaaaacaactaacaagatagtaaattttgaccctccatataaatagttgctttaaatgtgaaaatgtgaatcatctaaaagacagagatcatcagattggattaaaaaaagcagacacaatttataagctgtctacaagaaaaagcccactttaaatataaagacatagatacattatgctaaatgaaagaagtcatgcacagaagatcagccactgtgcggtttcatttatatgaaatgtttagaaagggcaaatatatagaaacaaagtaggttaatggttgccgagggctggaggtggaaaactggtatttactgttcatggataccagggatcttattggagtgattgtgttgatggttgcataacttgttaaatttactaaaaatcattgaatcgtatgcttaaattgagtgaattttgtgggatgtgaattataactcaataaaattgatttaaaaaaacaataagtgtggtgatgcaaaaaaaaaaatgactgtggccagtttggccatttcttgtagaagagtctcagccacctgaaggcttccagatccttaataactcatcaggtccctgccagcacagggaacatcatagacctgtcagcacttaaaggaacaaaagtaatgaacatttacattaaaaaatgagtgtgaaataatgacattcccagaaaaacaaagattgaaatgttaatgtctgttcatttttgcttcagtgatttggtattctgtttttagatgtgtccactttaataatttttatatcttcctgatgacattatgatgaagggtctttccgtctataatatttattgtctagagtttatttcatctgatataaatgtagttactgtagtgcttttatgattggtgttacctggcatatgttttccagtccttttactttaaacgtatgtgtgtgagtgtgtgtgtgtgtgtgtgttttaatctacaacaatggttctcaactgggcaatttagcccccttgtgacatgtgacagtagctggaaatatttttggttgtcatacctgcatggcagctactgacatctaatgaataaaggccagggctactactaaatatcctatgatgcacagaagagctcttacaacaaagaattatccagcctgaaatttcagtggtgctaaggttgagaagccctgatctaaaatgtgcctcttttagatagcataaagtggaatcttggttttttccccagtgtgacaattgctgccttttgattgcagtgtttagtccagtcccctttaatgtaagtattcgtatggttggatttatatctgcaattttgctattattttctatatatttcatgaaagttttgattctttgtttttttttcactgccctccatgtgtgtgggagagatagtactagtttaccattttaattcctttgtgttttttccactatatttttgagttagtttcatagtggttgctctagggattacaatagtcatcttaacttaatctactttagtgtgatgctaatttaattccagtaaaatattgaaactttctttgattctaactccattaccacatccctccatcatgctagtatcataaaatatgtatcatctatataagctacaaccctaacaatacagcattgtaattattgtttaattcagttttatgtctttttaagagtttagagaagagaaaaaggtatacatgtatatagtgttttatagttactcatatttttacattttccagtgctcttaatttctttgtgtggctttgagtcattgtctagtatcatttccttttacctaaaagacttcctttagtatttcttgtaaggcagatctgctagcaacaaattctttgctatggatagcagcaaatagtcttttttaggtttgtaacgtgtatatagcccttaataatgtattgtttagtcttgcctatttttgtgcttcctgagtcttttttgccaatattttaaaaatgttgagtagttaatacatttacatggtctacatataaaagcaaatttaaaagggacagattgaaaaggtatacctcacccccaactctccatttctccttaacattgtagtaaccacttttcttagttgtttgtcatttcagtgtttctttacataaataaaagcaaatacaaatatacgtgctaatttccaccttttctctgaccaaaggtagtataccatgtgtcctgtactgcaccttgtgtttttcatttaatttgtcctagagattttgccatattggtacgaagaggtattcctcattcttttctttcatagctgcgtggtattctattgtttggatgtaccataatttagtcctttgttggtgggccctagggttgtttcttatagtaatcgaacaatactgtagcaggaaaccttgagcatcttatgtatgtgcgggtgtatttgtagaatagattcctgggagtgggactgttagattaaaaggtatatgcatttgcaattttagatgacattgccagattcttctcattagaagttgtagcattttttacttcctccacaatatatgaaagtgcttatttccccatcttctcaccaacagggtgtgttatcaaacttttggattttttttttttttcttgagacagtctcaatctgtcgcccagactggagtgcagtggtacgatcttggctcactgcaacctccgcctcccgggttcaagcgattctcttgcctcaggctcctgagtagctgggattataggtgcccaccaccatgcccagctcatttttgtatttttagtagagataggggttttaccatgttggccaggctgttctcgaactcctgacctcaggtgatcctcccgcctcagcctaccaaagtgctgggattacaggcatgagccaccatgcccagccaaacttttggatttttgtaagtatgagtgaatgatgtctcaacgtcattttattttatttttttgagacaggctggagtgcaatggcacaatctcagtttactgcaacctctgccttctgggttcaagtgattcttatgcttcagcctccctcttgagtagctcggattacaggcgcctgccaccatgcctggctaattttttttttctttcagtagaaacggtttctccatgttggccaggctggtctcaaactcctgacctcaagtgatccacccgcctcagcctcccaaagtgctgggattacaggcatgcgccaccacacccagccctcagtgtcattttaatttgcatttctcttataagtaatgatgaatatcttcttaaaagttttaagggccattcgtatttttttttctgtgaattgcctacttatattctttgtctattttttttcccatgggcttgtcttttctcttgagtcctaggagttttttgtatattacagagattagccctttatctgtgataaattgcaaatattttttctgtttttcctttttagctttgcttatgtatttcctccttcttagaagtttgttgttataactatcaagtgtttagaatcttcaatttttttatttttaaatttttattaaatttttattttttagagacatggtctctgtcatccaggctggactgcagtggcataatcatagctcactgtaatctcaaactcctgggcccaagcagtcctcctgccccagcctcacaaatagctagaactacaggtgcacaccaccacacctggctaattttaattttaattttttttaattttttatatggagtatggctatgttgcctaggctgccctcgaattcctggcctcaagtgatcctcccaccttggcctcccaaagtgctgggattacaggcataagccactatacctggcccatttttttttttaagatgcctggaccttatcattagaaagatattccccaccaaatggctaccaaattgtcccaacaccagtgactaaaatgtccatattgaccccactgatttgagatgccttctctttcatccactacctgtatatatttctggactttctgttctggtccattggtatttctctattcatgaattaataccacagtaccaattgttatggaccttagaacatattttaaaatctggtagggctagtggcttctcattgctttttttccccctgagtcttcctggttcttcttgtttgtttagttttgtgtatgactctaaaattagctttcctgttttctgtccaaatgcctattggtatttttattggatagcattggatttatgagtcgaagtgggagaatcatttttatgatgttgattcttcctattcaaagatatcctgtgactttccattggttaaagccttttgtgttcttctggagtgtttttgagtcttccacttaagttttgtacatttcctaagtttattcctggatattttatatttttggtactattataaacaaggtcttctcatccattttatatatatatatatatatatatatatatatatatatataattttttttttttgagacagtctcgctctgttgcccaggctggagtgcagtggtgtgatctaggctcactgcagccttgacctcctgggctcaagcagtcctcccacctcagcctcctgagtagctgggactacaggcatgcaccactctgtccagctaattttgttcattttttgagaagaccaggtctcactttgattcccagggtggtcttgaacttttgagctctggtgatcctcctgccttggcctcccaaagtgctgggattacaggcatgagccaccacacccagcctcatccattatgtctttaacctctattgttgttctagatttcctttattttctttttttaaaaagattttgcttagctccatttttttttcatttttaactctcattttcaggatattttctgaaaattttcaagtgattcttactatatttctgtcttacagtgaattatcttgaaaattaatgtaagaaatcaacattgtgaagattgattaggatttctagtgtaaatgttggatgtaatggtgagtttatcataagtccttaaagggtatgaaggctgaaccccagagtgtattttgacattggtttagtgaaggcaggctgagcatgaaccagaacttgaaaccgtgaaagttaacagattagctactgaataactattttagctaaatgttgagtggcaagggttaaaaaataaatatttatccaaaccaaaatatcaccaacttagaatgaacctctgagttaaataaatctgaaattttattcagaaatatattattattgcaattttattaaaaatttcaggaatcatctttttaaagtttgacattgaaggcaagagatcatttcttttctttctttcttttctttttctttttttgatggagtctcgctctgtctcccaggctggagtgcagtagcgtgatcttggctcactgcaacctctgcctccctggttcaagcgattctcttgcctcaacctcccgagtagctgggattgcaggcacccaccaccatgcccagctaattttgtatttttagtagagatggagtttcgctgtgttggtcaggctggtcttgaactcttgacctcaggtgatccacccatctcggcctcccaaagtgctgcgattacaggcatgagccaccacgcccagccagcaagagataatttctcagcaccatcagttgctagattgcatgtgagttcattagattgtatgtatgtcatacgaaagacataactagaaattaaatgcaactctaaaagtttgttttgcaatgttatgttaatgcaccaaacaattctacaaagactagaattatgttataatctaatatctattattgtatcttgtattgttacttaaatttttaggtatttattggcttaaccaaatatattgtttttccttaagttatttaattattgcactcttcattcattaattcactcaaatattcactggctgtttacctattttttaaagtattccctttttaaaagccaggtttattgaggtataatttacatacaacaaaattcatttcttttaaatatacagttcaatgagttttgacactgcgtacacttgtgtaaccaccaccaaaatcaagataatagaacatttctatccccctggaaatctgcttttgcagaacatgcccttcttctaccctagctcttggcaactactgatctgttttctgtctctatagttttgccgtttttagaacatcatgtattagataaccttttgttttctagcttctttcacttagcataatgcttttgagattcatctgtgatgtaatgtgtatcaatagtttgttcctttcttattgctgagtaatattcaattgtctggatatatcacagtttacttatatattcaccattcattgaacatttgggttgttttcagttatgaggtattataaataaagctgctatgaacatttgcttacatgtctttgtgtgagcatgggttttcatttctgttggaataaatacccaaggtgagattccttggctgcatggtgagtgtatgtttaactttaaaaacctggcaatcatttttagaagatctgaacatttttcatttccatcagcaatgtagaagcttttcagttgttccacacctttaccaacttttgttatttaggaattttaaattttatcaattctagtatgaagtggtatcttactgttttaatttgcatttccctactgactaataatgttgaacatcttttcttatgcctatttgccatccatatatcctctttgaagtctctgtttgtacttgtttgcccattttaaatttatctttttttgtctaattgagttgtgtattttatattttctggataccaatccttcgtcagataagtagtatgcaatattttctacctgtctgtggcctgtcttttcatttcctgaactgtgtcttttgaagaacagaaattttaagtttttgacaaagtcctgtttatcaattaatttttcctttatggcttgtgctttttgtgtttatcttaatacattcttaataggttaactattttgtatatcaaattaaccgctctcacagtcattaattggtactttattcttacaataataaagatcaatatatctctcaagagattaatacaatttttattccatcttacatatagacttaataaatacaaatggtacactttttttatattactcagattgttatgctggtcactgtgctatcgtgcaataattggtcactaacagttaagggataccaaaaatgatattgcaggagacgttcagttacttctgaagatcagagatgatttttgcctaagtcaaactttgggatatccctaatttacattggctagttctttgtgtttattttggcattaagtacagatttaaatctttccacgaagagactcaagcgcaatcataatttttcacaagactaagtcatatgctggttacccaagcatttgctgactatttgttgtacagggacacaggctctactcacaaggatggctatgggaacattgtgcaaagggagttattaagcaattagctttgcgatccctctggcgtatcttcctcctgctgtggaatcaagagagtggtttggatgaggcttgtggcctttaatatttcatgtgtataaggatcactgtcatccagacatcggaacttttaaaattccatgactttccttcactgtaccagagtaattgtgacccagcttcatttgcttaaatgcagttaaggttttgctgaatttttagtgtttaagagattgcattggggtaccaggtgataggaagagaaaataaaaggtttctgcccccgagttgacactcttgagtgtaacacaactgtgcacagtgagccaaagggtgaagcaggctgtgtggctgagtttagggtatgcggggatcagttgtaggagatgagacaggaaacatattcaggcaatagattgtgggggaccttgattgcccttttggggcccaaggctgcattccattaaaaagtgaattggcattcatgagtgaaggcttgggctgatataggcctacctgagagtgaccctggcctcctatgctctatgttgttgaaaacagtaagagttaagataattgggggatgttgcgcctgccttggttgtcacatggagctgcccctccactgggaagctgtaaattggcatggggacatttggcatgcctgagggtggtataaaagattgacaggaaaaggggctgtttttttcatcagcaaaatccgcaaacatcttgcctatcatccgtggcagtcatacgtgacctgtgtggatgagggacacaagtagctgtagacttgggtagctgctggtcctcccattgagatgaagctgcggtccctgatgggtttcctctcctgtgtcctaatataaagataagtaaatattgtattaaatggaaaccagtgtgtgtcttggggctctggttgccgcttggtctcatcaccatagctgtgccactgcactgacaccttgaaatggaaggttagcattacaaactgggctaactggactcgtgttggggatgcaggggatctgaatgggggttagagcaatgacaaggtgagaatagggaggatcatctgccttcaggacagacactgagactcctgtcagcagttctggcacatggtctggggaagaaggaagaacagaacttccaactttagctctggtgagaggtctgaatggggccaagggctcttcttagctgtttaaacattttaaaagtttttattttaaataacaaaatttaacagtgcttatatatgccaggcaccattccaggcattttattttatttatttttattattttgtttttgagacagggtcttgctctgttacccaggctgcagtgcactggtgtgatcatggctcacagcagccccaatgtcctgggctcaaacgatcctcccaacttcggcctcccaaagtgttaggattgcaggagtgagccatggctcctggtccattccagacattttataaatattaactcatttaattcttctaacaactcaataccatttatagtttcctgatgagaaaattgaggcacaaagaagttgagtgacttgcccaggtcatgtagcttagtaaatgatgaagctgagctttgaatccgggcagtctgcctctagactccctgctctgaacccttctgattcctatagctcctcttccccatttttcctcataagaaataagtggtttatggttttgctccagtgtttgggtttctttgcggccgctcaagatcaaccaattcttcgggaaagtgaaacccaaggctccactgcccagcctgactgactgcattgacatggtggacagcagggcagaatccattgacaagaagatttctcgattggatgctgagctagtgaagtataaggatcagatcaagaagatgagagagggtcctgcaaagagtatggttaagcagaaagcctcgtgagttttaaagcaaaagtggatgtatgagcagcagcagggcaatcttgcccaatagtcattcaacatagaacaagccaattataccatccagtcattgaaggacaccaagaccacggttgatgctatgaaactgggagtaaaggaaatgaagaaggcacacaagcaagtgaaaatcgaccagattgaggatttacgagaccagctagaggatatgatggaagatgcaaatgaaatccaagaagcactgagtcgcagttatggcacaccagaactggatgaagatgacctagaagcaaagttggatgcactgggtgatgagcttctggctgatgaagacagttcttatttgtatgagacagcatctgcacctgcaattccggaaggtgttcccactgatacgaaaaacaaggatggagttctggtggatgaatttggattgccacagatccctacttcatagattggcatcattcaagtatatcttgtaaaacaaacacatattatgggactaggggactaggaaatatttatctttccaaattaacgtaacagatttacgtttctttcctttctttgaaggaaagtttaattacattgctcttgtattttttccattaggagactcattgtttgggaaacgctttttttgtactaaaatttgattccttttttcttatgaaaattgaacttagtttaaaggtatctttggcttgtatgacttgttttcattcattagtaataatttgaaataaaactaaggaaatggaatgttaaaaatctatgacactataactctgcagtctcaaaatgacctgataaactgataagacaaagatgagattattggggctgttcatattatgtttcagaaccattttctattgtggtattataggttggttaaagtgatggcctttttgatgggttttgttgtgtcttgtgaacaaatcattactgtgtccaatattggaatggagttatcactactgtatcatgagtgggtatttttattctatggttccctcagtattacatcttgacttgtaatcaataatgaatatttcttgatatttaatgtataggacatttatttatactcaataaatatttttcaaaaggatataattttaatgatatcacttcagcttaaaacctctactgcggaaaccacatttaatagaattttaatgtcattttagcctataactccactccagaaaccaagttaaccattgtgaggaaagagcaaggaacaatctgggcttgggccctgggtctaccatttactaactactgagtagtctattcaacttctctaagcttctgtttccttattagtaaaatcatgcttatatctcatagagcttttgtgaggaataattgaggtaatggtcataagtaccttattaaccgcaatgggctattctcatatgagggattgttaacaataaaaaagcaactgcttcaaaaaaaaaaagtggaattaattgtttttaaaatgtcatcgttgctgctgttgttgttttgagagggaatctcactctgttgcccaggctggagtgcagtggtgtgatctcttctcactacaacctctgcctcctaggttcaagcaattctcctgcctcagcctctcaagtaactggggctacaggcgtgcgccatcacgcccagctatttttttttttgtacttttagtagagatgaggtttcaccatgttggccaggctggccttgaactcctgacctgaagtgatccacctgcctcagcctcccaaattgctgggattacaggcgtcagccactgtgcccagccaaaatgtcattgttatgactgagtcagaacactcacacaggttacagctgcacagggtgacatcaatgggcagtttccaggaagcatggattccttatggtgtgtgtgggtgaatatagcacctgccctttggcttgtacccctgtcctacataccgaggaagtcctatgctatggttttagggcctcatatcacatttcttgacccgctttgctactgagacagccccctctccaaaattcttgaggtcggaaggtgtatttccccctcctcttggcatccttgacagggtccatggctttgatgctcctgtagtctcctactttgcctttccataggagagtgagtaaattttctttgggaggaaacccgggcaagtctgaacaatgagtgtgcatttggggctgactcagggattcagacattgctttgtggtggtgtttttgctttcttttcttttctttctgttttttttctttctttctttctttttttttttttttttttgtagaaatcttattgccgatacaccacgggctgccccacccagacacattagtcatggcaaagggagcaaatcattcctttttgaagatgagccttatattacatgaatcattatattaatccttacatgaagtccacctgttatatatgtggtggtgattgtattttgtccatatttcctttgctgggtggggagatcaactgtagctttttcatcctgattttcattccttgctacaaagcagtgatttggtttctaggtcggcattgtaaggagcctaatgctttgtcacagtactccagctcctcacactgatggctgaacagaggctgctaaaataggttgatcaagttgtgtttttcattgtcatattttgcaccaaatgaagtgtgacacatcccactctgtgacagaaactgtgagtgacaattggttccgtgtggtggcctaaaattacagaacgttacctgctgcttactaaggaagaatcttctggaggttttccctgtacctctgattggagcccacaatagaacttgtgtatggcatctaataaattgcaatcccagtgtgacaaagacctgtaggcacagagaagaaataacttggtcacataaagttttggagttcccaaatcactcatttaatgttatttttaaacatccatctctcatttggttactttctttaatagtccaattctttatgtgtaatacagaaatcaaatataaatgggattgataaaagtccttctttgcctcgtggaattttagtttttacaaataaccttagaataattcaggtaactaaggtatttggagtaacagtgcttacttgtacatgaagaactcaactatcactctctgttccccatttttctgcaagtaactcaattagctagattaacaaacattgtcacagaaacaaagtgttttttttaaagctatggatccttgtgtttatatttttaaaaagccataaacaggcatttctaccttattaagaggacttaaacaggtgtttaaacactaagacagtgatgattttaaaacataataaaactctaagttaaggcttttgttttgaaacccacattcatagctacttatatgtggaacacctttgtatttgggggcaacgtgctattaaggctgttgttgaccctagtactcactactcgcccttacacacacacacacccccacacccacacacacacccaccagagagaaacagtgtttttttagaacccaggaccatcaaaatagttttttgacttatcaagccttgaactggaataggaaacccacatttgttctagtgtttatgtgtttaatagttcataccatgaagttatatgttgattgcagatgtgggaagcaaaatggaaaaaaatgcatcttgctgacaaacatcgccgactgccttcactaactgcacttagcacaatacgtaatcatcttttctctttgtttactcatttatgggctacccctccctacctgctctagactgaagttgagaaaggcaaggcctttgcttgtcttcctcgagattgctcagatattgtttgcaagagagtccccatagcctttggtgggttggtggctgtgatagggagggtcttttgtcaaccctgggccttcactttggaagctgtgctgtgttgcaattaattctaataaacccatgcagcatctgaagataaccccacagggaattgaattttgaagcaaacgtgtttatttcttggaagcttaatggatggattggaaaaaaaaaaagaatcatttgcttctagctttggaagccagagaaaccacaggctgaggagcatgcccttgtccctcagtctcctattagcttgcagctctaatttctatccagggtaatatgaccgaggggaactatttgcatctttgaaaattccactcttctgctggcttataacaatagaacagtgcaaatgtatcttgtgtgttctctaccattatggataattactaatgaagtctctttctggcaattctcattaagtgatttaattttagaagtggaaagaaccatacctattggaacacttgaatctcaacagactattaaactttattaagaataagaattattccctggaattttgtaagatcaccttaaatcaaattatattttcaaaaaggaccataaagataattgcagtaagaaaaaatgttttaaatcattattaatgtagttatatgtataaggaccagaggcgatccttttgtgggcatgccgatttgaagtcctttgttcagcctgtttgttcttaagtttagattttgttgtactgtgaggccttacgtttaacatccactcatgtgatgctttatcacttttttgagaggttttattctggaaattcaggatatagtcttggcagtctaaaaacgtaggtggttttgctttgttatatcatctcagtgatcttcaggagttatttggatgatcagttccatcagctagggtccccttcttttctcttctctgccacggctgtgagggaggtcttggaggacaataatgccaggtagaggaggatgcaaggtgtatgtggggaattctgaggagttgaatatgagtgtttatgtgtaggggcagatggcagtgggaagtgaaattggcaggtgccagtgctttgtgggccttgaatgccatgttaaggagcttggatttttttttttcccatggatgatgaagctgctgaataattttaagcagggtcatggcgtgactagcctcatttgtgattcagagaaattagtctggtggctgatggagaaggaatgattggggaatcaggggagaagcaggggggatagttaagaaacgactgcagaaaatccagtcagggagcttgaaccagagtaatgataataaggagaagagggggtgatcaggaaaatacttgagaagtagagttggcaggagtgggaaaggacaggatatgggtgtgatgaggtgctactcagtggcactaagtttttatgcttgaatcaaataattgctcaagtcctagaaccaaagttagtttctgaggaaagtcttgtttgtgattatagaacttctcttcagcagacaagaatatgcaggtcaagatctttgatttctttttcataacaagtatcattacaaccaacatacctggaagatgtagcctatagatcttttatgttaccagctattgaggtcctcagtaatgaccttaatcatgtttgttgttcatcttgttcttgtcagaaggctggctgaaaattttggtatttgagagaggaatgttcttaaggaatatattacttactagtttctcaaaaaacaatttaagtcaaaacatcaggaaatgacagattagaccatgttattgtgcccttcagcctttcactcctggaattgcccttatagaaccaaactaactttatgtctttagttttctcttagagctactcatatatggaatgccttcacatttaggagaaaaatgttattaaggctattgaccttcgtggccccctccccctaatttccacaaaaccctgagatagtttcttcttagagcacaagaccaacaaaatatttttttgagttatcaaaccttaagctagagtaggaaacctatgtttgttctagtgttttctattttgttcttgtcagcaagaagcacaaagttttaagcttattttctatggttttcctcaaacaacttttaaaattattatttttgttgtgctcttttatttattttatttattatgctcatatattaactggttttgtgtttttagtttaacccattttagtcagttggataaattttttttattatactttaagttctagggtacatgtgtacaatgtgcaggtttgttacatatgtatacatgtgccatgttggtgtgccgcacccattaactcgtcatttacgttaggtgtatctcctaatgctatcccttccccctccccccaccccacgacaggccccggtgtgtgatgttccccaccctgtgtccaagtgttctcattgttcaattcccacctatcagtgagaatatgcagtgtttggttttctgtccttgtgatagtttgctcagaatgatggtttctagcttcatccatgtccctacaaaggataggaactcatcctttttatggctgcatagtgttccatggtgtatatgtgccacattttcttaatccagtctatcattgatggacatttgggttggctccaagtctgctattgtgaatagtgccacaataaacatatgtgtgcatgtgtctttatagcagcatgatttataatcctttgggtatatacccagtaatgggatggctgggtcaaatggtatatctagttctagatccttgaggaatcaccacactgtcttccacaatggttgaactagtttacagtcccaccaacagtgtaaaagtgttcctgtttctccacatcctctccagcacctgatgtttcctgactttttaatgatcgccattctaactggtgtgacatggtatctcattgtggttttgatttgcatttctctgatggccagtgatgatgagcattttttcatgtgtctgttggctgcataaatgtcttcttttgagaagtgtctgttcatatccttcacccacttattgatggggttgtttgattttttcttgtaaatttgttaagttctttgtagattctggatattagccctttgtcagataggtagattgtaaaaatcttctcccattctgtaggttgcctgttcactctgatggtggtttcttttgctgtgcagaagctctttagtttaattagatcccatttgtcaattttggcttttgttgccattgcttttggtgttttagacatgaagtccttgcccaggcctgtgtcctgaatggtattgcctaggttttcttctagggttttaatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgttttcgtcaggtttgtcaaagatcagatggttgtgtatgtgtggtattatttctgagggctctgttctgttccattggtctttatctctgttttggtaccagtaccctgctgttttggttactgtagctttgtagtatagtttgaagtcaggtagcgtgatgcctccagctttgttcttttggcttaggattgtcttggcaatgtgggctcgtttttggtttcatatgaactttaaagtagttttttccaattctgtgaagaaagtcattggtagcttgattgggggtggcattgaatctatgaattaccttgggcagtatggccattttcatgatattgattcttcctatccatgagcatggaatgttcttccatttgtttgtgtcctcttttatttcattgagcagtggtttgtagttctcctttaagaggtctttcacagcccttgaaagttgcagttggataaatatttaaagtatgtttctgaaatgaataaagattggggccaggcatggtggctcacacctgtaatcctagcactttgggaggctgagatgggtggatcacttgaggttaggagttcgagaccagccttgccaacatgatgaagccccatctctactaaaaatacaaaaattagccaggtacagtggcgcacatgtgtaattccagcttctcaggaggctgaggcaggagaatcgcttgaaccccagaggtggaggttgcagtgagctgagattgtgccactgcactccagcctgggccacagagcagactgtgtctcaaaaaaaagattttggatgaccctacatcagtattttttgggacatttaagaagatgactgctccttgtgcagtaattttctcttaaaaacttcaaaacactttattacacaaatacaagaaaaattaacacaagtatcagggtgatttttgtggtacaatgtggcatttctaatcacctgacctttggtataattagtatgtataatgtatctgtccatcttatagaactcagagcaccttttgagtattttccaggaatatgtaacacaatttcaactttggtttttatgacatagttcttgtctgcaatgctgattacttactcaagaatgggacacccccttcccaattatttcacaatttctttaggaaaatgcggttattctggtggatgcgtgttgccataactcatgagaccaggtgtccacaatggagaagtagggctaggattttttgtttcatttctgtcctgggcagcctttatcgttttggtcagagttctggctttatccagaagccaagtgacttcagtacaaggtggtttccccttccccaaacagcagggaactagaatcagaaacaggaaaaaataaataaataaaaagaaacacattatgatcaaaatagcttcaaataaggttttaaagccacttgggtactatttgcctattgatatcagaatcgtcccttcttgtttgggtataaatcagttagatctccaatttgctaatggttacaatggatattttaaaccagaagagtcagtacatttatgatagccatagagtctgcatgattctatatttaaagtgttttagggggtgagtgagtgggaatttgagaacagacttgggcaaggaaattccttcccctctgtgcttttgtagcacctgtgtctgttgcagcatttgtgctgtgtgctagagcttctggtcttactgaagaggatcctgcctaagtcgtctcagggttcatagcatccagtggctgaatgtttattgaattaaggcaggcaatagggattcctttcttggtttatcaatgtttgtttcttctctttttaataaagaaactggctggtttctatttgcgtgctcaaaataagcatatctttaccaagtcagagccctctaaggccctgcaaattctcaccttaccacttatccccttaatgatatatcatgcatctaggtttatgcatctgagcattggactgggatctagaagtctcaggtctgagtcactccttcagtcttcagtacccatcttcacttgagcagaccacttaatatctctagacttcaacatcttgatttataaaataagattactattataagtcaggggctgtctatatgtgcactgcctgccttaaggacttttgccagaaataaaattaagtaatgtacagatgttccttgacttatgatggagttatgtcctgataaagccatcataagtttaaaatattgcaatttgaaaatgcatttaatgcaccttacctaccaaacatcatagcttagcccagctgaccgaaaatgtgctcagaacacttacattagcctgcaattgggcaatatcatctaacacaatgcctgtttcataataaagtgttgaatagctcataatttattgaataccatactgaaagtgaaaacagaatggttgtatggatactcaaagttcagtttctactgaatgtgtatcgcttttgcaccatcttaaaggggaaaaattgtaagtcaattctaagtcagagggcatgtataaggcttctcaagactgaaaaatacactctgtgcgacatttgtcattttcaactaaccgagaatgagggcacattcgcaaaaatttgattagattcagaatttaaccttataccactggactcatatttttgggatcagtgaatcataatgtagttattaacaattttgtgaccatttccaggaactaactgtaactgagccattacaaagaaaaagctgttcagttatagggacccaaaaatataccaaatcagtcaagtgtttattgaatgcctactgtatgcctgttactgtgctattccacatgtgaaatagaaaagaaatcttacctataggtctgatcctcaaggaatttacagtctagttagggagggaataatttaagaactggactaatctgtgatataaataaatactttaaaaattctttaaaaattatttttaggatacttattgagagaaatgagatatcaatgtgagtaaggagcttgggtagggtcttaaagagttgaaattaaacctgggaacataatccaagtggaaaggaattttgtcaagatggaataatttaatctagcgcaatgtctgatatatagtacatgctcaataagtattaatttgcttgatgaatgaatctctttcaacaaatttatcttctagtttgccagttctctctttactgtgtctagtctgctgttgaacttgaaaatgaaataaaaatgctaaggtcatgtttttcttttccaggatttctattggttctttctaaactcacaatcctctactccacactacactccttaaccctttccctgccttatttttagccatagcacctaccgtattctaacataccatgtaatctacttattttgtttcttatgtttcttcccttattagaaatataacgaagtccagaaaagcaggaatttgtatttgtttcgttcactgacatatatctccaaacactagaacagtgcctgggacatagtaggatctcaaaaaatatttgtcggggatctcaaaaaatatttgtcggggatctcaaaaaatatatgtgttgtccataagtatggaggcaatagtgaaacctgccaaattagattggggtggagatgaggtccttgtagagtccagtaggaaataaaatttggggaggggcttcattatggccagattatatagagcatcctgtgttgaggggaggtttggggcttcaacgtagtaggcatgtatattatttacaaagctgagccaaatatccataatttacttgtcatctgggagacatcaggaaatagcagaaagaactctggctttggaattggaagtatgcaagttggaatcctacttctacagtttaccagctatgtggtcttagggcagttacttactcttgaagatccagtttttttttttaactgtaaagtggtgttaataatccctacctcataaagttgtggtgaaaattaagagataatattgtaagtaaaacccctaatacaaagtgggtgcccagtaagtagttcttagactacactgactgatttgaaactattagcatactaaaatgtactttttctgtttggggcacattacttagagtagtaggaagaagcagaaaacattgagtatagtatattgaggtagagtattgtaactgtggtttaggaaaaataactaccaactgtgagtaaaaatgaaaaggaagatactatatttgggtgttttacagtcacgaaaaaaaaaaacccacagaaataactagtatcttttcacttctccaaaacgttttgaaaccttgagttaattaagaagggagaggaaaatcccctaataatactagagtcactaatagtgtggtctctgaaagtaccgaaccacagggaagtcaccgggttctggaggagatcagctttcctggagtggtccagtcctcatggatattctcttctgggtaggacctgcatgttgacatgaacctagggcactaacttgaccctccgcagaaaaaactttcaatgttaagtcctctgcttgctaaaggtcacccaagaatatttctcctggagaagccttgtgcattttcttttcttttcttttgtcttttttttttaattttttttgagatggagttgtactcttgttgcccaggctggagtgcaatggtgtgatctcagcccactgcaacctccacctcccgggttcaagcgattcttctggctcagcctcccaagtagctgggattacaggcgcccgccaccatgcccagctagttttttgtatttttagtagagacagggtttcaccatgttggccaggctggtcttgaactcctgagctcagatgatccacccgcctcaggctcccaaagtgctgggattacaggcatgagccaccatgcccagcctgccttgtgcattttctatataactggttgttaaagatgttatccttttttgctaattgacccatggataaggggccatctgacagctttgagaatttaggattaagcaaacatttatttctcttaactggttattccctcttatcagattatgagaattaaatagcacacaatgcttcctttttgtttcagttatcaagaaactcagagcaccatgtaatgcttgattacaataacaaaaagtctaggaggaccataaatttacttcctccttgtatgctatagttcagtactgtcgttttctattttaagtggcttgctgtgtagagcatcttaaaggctttacaaaatagcctgagtatacctaatttggcatttgactaatttaacatttccccagatgtgactcaaacattttgtaaatgtagtgaatttaaaagacccaggtgtctagcagtagggacatggtttaataaactgtggcatattaatacactgcatttagaatttttatcttaaattctaaagcaaatctgtcactgagcccttatacaagactcagtgcacaatgtataactgaacagcagtgaacatgaatgaatttatgtttcaacgtgagtaactgatatggtttggatattatttgtcccctccaaatctcatgttgaaatgtgacctctcatgttggaggtgggcctggttggaggtgttttgattaatgggggtggatccctcataaatggcttggtgccatccctgccactaatgagtgagttcttgatctgttagttcaggtgggatctggttgtttaaagaacctggcatctccccactctctcacttgctccctctcttcatgtgacatgctggctccccttcgccttccaccatggttataagcagcctgaggcccgcctcagagacagatgtggacactgtgcttcctgtacagcctgcagaaccatgagccaaataaacctcttttctttataaattacccagtctcaggtatttgtttatagaaatgcaaatagactaacacagtaacctgcaaaaaacataatatggagttaaaaaagggagatgcagcaaaattcattcagttaatacaacagaaaatgctgcttgtcccccagtatctgctttccatttttttcctcataatagacttttagaaggttcaatgacctcccagaaagaagactttattttcttgcctctcttgcagccaaatatgatcatatgaccaagtacttggccaataggatatcagtggaagtgtgtgtgtgtgtgtgtgtgtgtgtgtgtgtgtgtgtgtaatttagaggctgtgccgttaaagggagtgccttccctggttgttttctcgtttccctttgcctgacacgtgggcctgatggtgagggcaacaccctcttggtggtagagcaggaagattagggaggggtagtgagggaggagtagggagccaccacttcatcccaggaatacttatgcactgactcttctgtgaaggaaagagaaacttgtctaagccaccattattttggtctttgttccagcagctacacctgcttcctaattctatatgatactatttatgtaagttaaaatgagcaaaagaatatttattatgtatctgcggacatgtatatttagtaaacctggactggatacagactaaaatgaatgacagttgcctccgaggtagaagggaaggaatgggaccagggaaggaggaaatacagcctacttcctctctttacactaagccacaagggattctctcttttctgtgtgtcgtgctcagtcaactatgtcagagtaggacagtcaattcaatgatgaagaatctgtatgtttgtgatctttgtgattgctttatgccacgcggttttctgttggcttttaacagtgacttttaccccatatgaagtgattggattaagagaaaatagtggctcacccttaaaacaaatgtggaggacagagccatggctgtcataacaggagtgagctatgaaatagacctgggaaaacagatgctattgcagtttgatggtaaggcctgtggcacaggtgttgctggcaggctgcaagaggccccaacagggggccttctccatttgcccagactctagacaatgccattgctggctcaaaagctgaaatcgtcagcagcctgggtgactgtctcttggggtcaggctcacgttaatcaggctcagagagcctgaggctaaaccagagtgccaatcgattaatttatgataagagatttggctgttgcagagcagaatgtatgttcaggctgagcagagcattttttttctgagtaggcaagtagcaggggaccccaggttgtcatcagaaagttgcttagaaaggacagaggaagaacagaggcaattggttatggtatgctcataaatagactggaaaagcctgatgggtccatctccttgctggaatagccttgactccacctctccccactaacagccactgtatcctttcctttatcagtggttacatgcatgatctcatcatctgacttttggagtcagcctttcttctctctctctctctcttttttttcccacagtatttttttcaaactagattccacagaatggactgggttttccctaaacgaatctcaggtgcattccaggtgagtcacattgcagtttggggattcccaggctcttaagggcatacaaacagctcatctggtttactccctcaatttgccagttacatccaacatatgacaattttgctggctaacactgagggaaccttcattctcttacctctaaatctatgggggccctcactgtccacttccctattccaggtacattccatgatgcatttagttgtatttctgaatgcggttcttcttgtcacatggcagtccttctgtcttcccacttgtccctgctttcactctgtttacctaaatgtggaagtgcctaaggggcagtccttgctcacataactttggctctctgatgtgtggctttagagatcatttgtgcacagctagcttccaggtctttatattcagtcctgaatgtattcttacaatacagtcctaaaagtcactccttttataagtagttgttggacaagataatacatatgatagtacaaaattcaaaagttagaaggcaaactgaaaaaccggcctccctttctccctggagataaatgtattccattgtcttctctggagacaaatacactcatcagttgagccatttctgcctgaatgtgccatgctgtatttaaaatcagcgtatgtaataacgcagttggcactgttgctctagagtgccatcaacacccacctagatgttgaggtgccctcccttctcacattgcctaatggttccccggagaaccttgagaaccccactgctatagtataaactaaaagaatggctgctggaatttccttacgatgcttttttgcttttgtagaattcaccttcagttagctatgaactctcagaggatagcaattgttgtatgctgtttctggcatatcccctttagtgctttacacagtcttatacatacagtagggtttttttttgttgttgttgttattttaggtaacattttttgaactttttttgttagtttaggtaatgggtgtaggcatttgtttttaaaaacatcaaaaaaagtaactgctggcagaaaatgtaatgaaaagaagatgagcagctgcctgttgtattatgtattatgatagcttagtacctttaaatttttttttctgaacttatttttatttttgagaacagagtctcactctgtcacccatgctggagtgcagtggtgtgatctcagctcactgcagccttgacctcctgggttcaagcaatcctcccacttcagcctcctgagtagctgggaccacaggtgcgcaccaccgcagcaggctaatttttgtatttttttttacagagacagagttccactttgttgcccacgccggtctcgaactcctgggctcaagtgatcctcctgccttagcctcctaagtagctgggatgacaggcatgtgtcaccacgagtttagtgcctttttcagtggaacttctttccttgttctctgatagtgtaccactgtcctacctcagcacatcccacgacactgcctgagctcctttcctccttaccacttacaacatactatttaacgcatttatcttatttttaaacatctttccccctgctagaatgtaagccctatgaagggagggcaggatttttgtccctgttgttgactcttatgttcccagagcctagcatatggtaagctgctcaacaaatatttgttgaatgtataacctggtgagataccaattgtttatgttgtcattgaattgattaccatcaccaatcctagatttctctttgttctgtcccccactgatactaggtatcagtgctttgagaccaggaagacatttttcgtttctctgcaaacaaaacctgtagtttggggctgagtgacttagaggcatgtggaaggaagaaagaacataatcagtggtgctagaacacaacgccttgcttgggctctgctgtcagtgcctgacatattctccaaacaacactccccacttgtattttactagcctagtttgagtacctctttttttttttttgagacggagtctcactctgtcgcccaggctggagtgcagtggtgcgatctcgtctcactacaacctctgcctcctgggttcaagcaattctcctgcatcagcctcctgagtagctgggattacaggcacccgccaccatgcctggccaatgtttttgtatttttagtacagctagggtttcgccatgttggccaggctggtctccaactcccgacctcaggtgatctgcccacctcggccttccagagtgctgggattacaggtgtgagtcaccatgcctggccttgagtacctttaataaaggtgattcatgtccctatttgttatttccaccacagagtatatcatttttcgtggcttaatttttcttttttaaaaaaatttttgagacagggtcttgttatgttacccaggctggtctcgagctcttgtgctcaagcagtcctctcacctcagcctcccaagtagctggcactaaaggtacatgtcggccgggcgcagtggctcacgcctgtaatcccagcactttgggaggctgagggcgggtggatcgcttgaggtcaggagtttgagaccagcctggccaacatggtgaaaccccttctctactaaaaatacaaggattagctgggcatggtggcgtgcacctgtagtcccagctacttgggaggctgagacaggagaattacttgaactcgagaggtggaggtcgcggtgagctgagatcgtgccactgcactccagcctggacgacagaaagagactcttgtctcaaacaaacaaataaataaaggcacatgtcaccacacctggctcaatctctcctctttttatggttaatatctcttttgattcttttgcttagatgctgtcactctgatattaaggagaaggccagtttattgcatttgagtttgagctttaactaggttatttagtctcacacagaaaaattctgttttgtggccacattttgcccatgtagtcaggcagctgccatgaatatgtgaaccttgggctccctttcctgagagggcagccaagtagaccttggcataaatacagaattgagaggatgctggctagtgacgcgggctttttggtaggggctgcctggccaccttgcctcaagtgatctcctactgtcactgtggatgtcacatgcctcctggctgtgccacttactagtcagatccttaattagttctaaaatggatttcatgtcctttgtgagaacggaattcaccaagatgatatcagggaaatctcattaccttataaacacaaagagatcagatcaacagatcttactttgctgaagagttgggcttttgtcctctagctggcgaggagccattggaagcctttaagccagcagaggtgtttcttttagaatgactatccttgcagtggttttcaggtaaagtactgaggagtgtgagatggatgcagggaaggcaagaagctgtcaaagaaaaagtttacctgaggctgggtgcggtggttcacggctgtaatcccagcactttggtaggctgaggcaggcagaacacctgaggccaggagttcgagaccagcctggacaacatggcgaaaccccacctctattaaaaatataaaaattagccaggtgtggtcgtgtgtgcctgtaatcccagctactcgggaggctgaggcaggagaattgcttgaacctgggaggcggaggtggtggtgagctgagatcatggagaataaaagaaagaaagaacaaataaaaagttcacctgagaagaatggctgcccctgggcagaacctagatgcctccagtgcaggtgaatgacataaggataactcccaggtatctggttctcacagggacagggaatgcagagaagaaacaacactgatggggaggagagagacttactcttggatctgttgagttagaggtgtcagagagatggcaagcagaggtttagatgtaggttgtggaacaccatgggagaactctgtgctcaacctacagttgctagaactgctcctttaaagttcctgctgggtgagtgacttttaaaatataacctcttattatggaaggtttcaaacacagtagagacaatagtataataaaccaaatcccatgtacccattaccatgctttgttaattaccagctcatgatccgtcttattacatctataccttccagctacctcttcccatgtcaaggtgattttgacacaaattctagatgtcgtgtcattttattaggttggtgcaaaagtaattgcggcttttgccattactttcaatggcaaaagccgcaactacttttgcaccaacctgatatttgtaaatatttcaatatttatctctgaaagacagtcttgtaaaaatatagctacaataccttatccatccttaaaaaccatagtaattttgtgatatttgtcaaatatccagtgagttcgcatttccccagttgattttttttaagcttcatttatgatgtaactaagggccctccaacagcatttggttgatatgtctctgtgtctcataaatctctcttaatctgtagatttgggtgtaaaacttttcagagcattttgggatctatttgtgtgaacctgaactataaccagcacttcaacaaaagaaagaggtagaggaatatgggataatgtagggatcttctctttttttccttttgagacagggtctcactctgtcatccaggctgtagtgcagtgacccaatcatgattcactgcagcctcaaactcctgggctcaagtgatcctcctacctcggtctcccgagtagatggaactataggtgcatgccactgcactcagttgattttttaatttttttgtagagacaacatctcactgtgttgcccaggctaggctcaaactcctgagctcaagcaatcctcctgcctaattttttaaattttttgtatagatgtagggtctccctatgttgcccagctggtctcaaactcctggactcaagtgatcctcccacctcagccttccaaagtgctggaattacaggcgtgagccaccacacccagccaagatcttcttaattggaggtgtgattttaagttttttcccctgggaggtatgatgcttccaggaaagcttgataaagctcttgtacttgtagcctctctctcctgcagtcaattctctgtactgctatggtatcttctaaaagtcagtcctgattgtacccctttttagtccagaagtctatgtggcctctgtttcctgtgtgataaagtcttatctcatgagcttggcttaaagggatggctggccatcttccttgtgccaacctccctgcttgacatttggtctccacccttcccctttctcccctgtgtgggctagctccagccatgccactgtatctaatgtgcactttcctacctcatgctaagggctttctctgaaatatacttcacgcctcctctttcctctgtacaagtctgactcatcttgaaaggcccaactgtgaagtcaccttttctgtgaagttttcctcaacaactttttcatctgaaagacttattcattctgttgtctgctatgtcgcctttttatgcctctgttttgtggtggttgttacagcctggttggctttattgtcagtagtgtgttggcaggtaggacaggtgtgtgtttgtgtgtttgtgtgtgtctcaagagggaagatactgtgtcccggccaggcctgtgtctccttagcactcagcacagagaccttccctcctgaaatacagggtccaccagttgggtacaactcttaggaggatgaataacagatttcctattctagatactccactccgtgttctgttttaaaataaatttattaagcagcctattaaaaatgacatagtttagagctaggctgaattaaaaccagtatataattagattttattctgtctttgtaaatgcataaaggatatcactgggtatgtgatatgaagcattccttgtgtcccagacaccaatttcatgactcaggaaatttcagcaaaaacacaaaactctaatctttccagatactgttttgttgcctgccaaaacttagacataaattgcagggggaagaaaagcattatgtccacaattaagagaattgacactttatgtgtatataatctgttactattatttgtgctcagattacagtttttgatgttcattatttcattctttcagcaaacatctgttgagtgacgaccacattccagacattgtgctgggttcagtggagcttgtagtctcatgaggaggacgtgcagtaacagttgtataggcaacgacagcacagggaaaagagtggttgactttgtgacacaggtggtcctgcagggtgaataggaactgatcaagtagacagggtagggagggtggagctcaggagacatacctgacagagtggacagtgtgcgccaagaatggagaagtaggaaatggcatggcttactttagtatttagctgtcattttcatttttaataggaaatatatattgtacatgttgtaaaatgcaaatagatcaacagtgacagttaagtcctatctttcctctgaccctcagccacacaagtcctctccttagagagagccactgttacattttcttgtaaatgcccttccacggaattatgatacatttataaacctgagatagatttttatctcccctcaaaaggtaacatgttatgcaacttgtttttcatcttgcttttttccacctaatgcataggatgtgtgtagagtggctgcattctttttaatgtaatggctatagactccattatgtgagtggacaacagtttatttagttggtaccctttggaggagacatttaggccttttataataatgtggtgtcgcctatcccatgatgtagattggaataagtgagcaacagccagactacagagctgagggttgtaaatatattcaactcttagttcagattctgctaacaaacagaaagtcaagcatgttggagaaagaaccaaatcgaattccaagaaatgcaatatattcattgaaattacaaactcaagataaagaactgaaaagacagcactgaatcctaaccactagactaccagatttaaatgtaaactatattaatcctagtagaaaacctagaaagtacccttcctgacatcagacttggcatagaattttttggctaagtcctcagaagtaattgcaacaaaaccaaaagtaggcaagtgggacctgattaaagagcttctgcacagcaaaagaaactattaacagagtaaacaatctacagaatgggagaaaatatttgcaaactatgcatctgacaaaggtctaatttccagaatctgtaaggaacttaacaagcaaaaaacaaataatcacattaaaaaatggacaatggaacagacacttctcaaaagaagacatacaagtggccaagaagcatataaaaaaagttgattatcactgatcatttgagcaatgcaaatcaaaaccacagtgcaatacccttccataccagtcagaatggctgttattaaatagtcaaataaaacagatgctggcaaggctgcacagaaaaggggaacacatatacactgttgataggaatgtaaattaattcagccactgtggaaagcagtttggagatttctcaaggaacttagaactaccatttgacctggtaatcccactactgggtatatatccaaaggaatataaattgttctattataaagacacatgcattcatatgttcattgcagcactattcacaataacaaagacatggaaccaacctaggtgcccatcaacagtggattggataaagaaaatgtggcacatataccccagggaatactacacggccataaaaaagaacaagattacgttctttgcaccaacatggaagtagctggaggccataatcctaagcaaattaacacaggaacagaaaaccaactactgcatgttctcacctgtaacagggagctaaacattagtacacatggacataaagatggaaaccatagacactgggtactatgagagggggagatgggggtgtggattgaaaaattacctgttgggtactatgttcactacctgggtgacaggatccatactccaaacctcagcatcatgcaagtatacctgtgtaacaaacctgtacatgttccccctgtatttaaaataaaagttgaaattatatttttaaaaacagaactgaaaagagaactggtgaactgaacagtggatctgaagaaattatccagaaagtgccacagagaggcagaaagaaaatgtatccatatgctgaaatactacacagcagtgagaccacatgaaccagaaccatgtgtcaatctggttgactctcacaagtgtattatggggagaaaaaaggcaggttacctaataatccataccatatatagtttaaaacatgcaaagttaaacaacatatatctgtaatactactctaagggcacagtaaacaccaaattcagtctagcagtgtccagagaatggggtatgggaatcgaaggacttgggtgggaagggataccaaggatgcttagctctcttggtaatgtgctattgattaagctgagtggtggacacccagatgtccagtagaccatttttatcctgataaattcttgtaaaatatattaaatatacaaaatagtatatgtagcttatatgcagaaaaaaatgaaataagcatgtccatactcactgcccggcttgaggaacagaaaattaccagtgcctttgaaccactccccccatgtattccttcccaattatggtatactttgcccctgaggtgtactatatctagtccttcatgtagctgatatatttcataataagggtttctttttgtttttgtttgtttgtttttgagacagagtctcgctctgtcgcccaggctggaatgcagtggcgtgatctcggctcactgcaacctccgcctgctgggttcaagcaattctcctgcttcagcctcctgagtagctgggactacaggcatgtgccactgtgcccagctaattttttgtatttttagtaaagatggggtttcaccatgctggccaggctggtctcaaactcctgacctcgtgatccacccgcctcggcctcccaaagtgctgggattacaggtgtgagccaccgcgcccggcccataataagagcttttaaggggataaagcatcttactagtatatttgataattaatttgaactcaaattttcatccccctttttaagaattgttgtgttggtcatctaagtaaaaattatatcttgtgtgcctatgataaaacttctaaacataacatattttcagcatctccccaaaatatgtgatgtttcaagagcatagtgaaaattaatcttccatctggccccatcagttttaatcagggagaaccaaagttaagtagtttcttggttagtgccttaggataataccatctacaaaagtggagttcatgtcaggaggttatatgtcagaagtctcctttggaagatcaaaaaagctcattttgatggtggtgtgggaagagggaaaaagaaacttaaaaacatatctggaataagggttagggaccctgtgttagagcaatggtaccttaacttctcatctgtaaaagaaatgtttactaattgggaggtgagatctgagttagcaatagggatgttgttgatggtctagagaagctatgtgcagtttcccaaaaagatggtgtattagtcaacttgggctgccataacaaaatactatagactaggcggcttaaagaagagaaatttatttcctcacagttctggcggccagaagtccaagatcagtgtacctgcatgattgagttcttacaagtgatgtgtacattgtgacttaaagaatggttaagagttaacctggtgaagatagttacggaggagagaatggaaagagagtccccggcagaagctcagaggaaaaactgattaatctatttcaaagcgtagctgatgtttagctgaaaatcttgacctgggtctctaaagagtgacaaacaggtcaggaaagtttgtgttcatctgtagtaacctttttaatccagtccttaggtaactgacttggatttgattaataagtttaattaaagggagaaatagacaaaacagcaataaaaatgtgttaaatgatccctcagccacaggcacactgtccttgattttgggaaatgtcagagtgtgggacagaaacaaatattcatacaactgatttaaaacagaaagctgatattataattccaaagggccttggacctaacccaggcatctgctgtcctcccattattttctgttcaaatatatctgtgatttttttttttttttgagacaaggtttcgctgtcactcaggctggagtgcggtggtgcaatcacggctcactgaagcttcaaactcctgggttcaagtgatcctcccatctcagcctcccgagtagccacacaccactatgcctgggtaattttttaatttttttgtagatacgaggtctcactatgttgcccaggctgttctaaaacttctgggctcaagcaatcctcccacctcagcctcccaaagtgttgagattgtaggcatgagccactgtgcatggcctgtgaattttattttagaagcattttaaagaaaatgtgtttaagagtacgtatgggtgcccctccatattgttgggacttgaggggtctaactagtgatactctaaattctctaccaaactgaagcagttgggagataaaggagccagatgggtagcaatcccaatgtctcatttattagtggcagagctagtagagtatggcttaggtatgtggcaacaattgacttcttgagaccgtagtcctggaataggcagcaataatccctccaggtcctgggactattgagctagcacaggccccaactagaatgaggcaagtataatcaacctacacttggataccatattgaactcagtaaaaagttcagttgtgaagcccaagtcttcctccttggttctagttttcaatgagcacctcttccattcaacattagaatgggcatgttcttttgcaaagactatcagaagaaggtatgtggtctcccatagagaaatgctgtgcagcacagcaacgatggcaagttcttcctggtgtctcacccaagagcttcatggcgcaatataactacattttccatgtctagttttcttaagtagtatataagacctaaaatcatttccccctcttattactaactgtaacattttgtatatgaggaaactacttaaaattgatggtgtattttgaatcacatgaacttgttccatcttggtttgagttaaatctttggaatttcagctgttgaagaagaggggcattggattggaggtcaaactcttggctgatgggcttgaatttcactcttttagtgtattgttctaaggggatgagatagaacttttgtcttgaagagcgattgactcaggttatttctttaattaaactcagccactgtcagagcagcactattcccaggttggtgagtcacagattttctattgtattgtcaagagttatcagtagctacctctcccccacactccagattctgagcccttttaaggatgaatttctgcctactgtccaacaaagtggagtgaaaaaaatgtacgcaaatccctttccccaagaaattattgaaaaggtaatatgttaattcttaatacttaaaagatcacgtctcagcactacaaaggtgtttaggcactggaatataaatccatggtaatagctaaactattccaaagtgtaagtcatttcacaggctgggtgtccatatgcagtaggggttcccgggcttgggagagagaacaaccagtccataaatgacaaacttttattatgatatatttatgtcccatgtactttaaaatttttaattgacaaaaattgtatgtattgtgtacaacatgttttgaaatatctatacactgtggaatggctaactctgtcagggaagttgccccaatattcacgtaggttcttttctattttccttaagcgtcggccagcttgagaaataaagggacagagtacaaaagagagaaattttaaagctgggcatccgggggagacatcacgtgtcggtaggttccgtgatgccccacaagccgcaaaaacaagcaagtttttattagggagtttcaaaaggggagggagtgtgtgaataggtgtgggtcacaaacatcaagtactttacaaggtaatagaatatcacaaggcaagtggaggcagggcgagatcacaggaccacaggaccgggacgaaattaaaattgctaatgaagttttgggcaccttagtcattgataacatcttatcaggagacagggttttgagatcaaccagtctgaccaaaatttgttaggcgggaatttcctcttcctaataagcctgggagtgctatgggagattggggtctatttcacccctgcagtctcgaccataagagatggccatgcccaggggggccagttcagggacccacccccaggtgcacattctctttctcagggatgttccttgctgagaaaaagaattcagcgatatttctcccatttgcttttgaaagaagagaaatatggctctgttcctccgggctcacgggaggtcagagtttaaggttttctctcttgtttcctaaacattgctgttatcctgttcttttttcaaggtgcccagatttcatattgctcaaacacacatgctgtacaatttgtgcagttaatgcaattattacagggtactgaggcgatatacatcctcctcagctgacaggattaagaggttaaagtaaagacaggcataggaaatcacaagggtattgattggggaagtgataagtgtccatgaaatctttacaatttatgtttagagattgcagtaaagacaggcataagaaattataaaagtattaatttggggaactaataaatgtccatgaaatcttcacaatccacattcttctgccgtggcttcagctggtccctctgtttggggtccctgacttcccgcaacataactcgagctaattagcctatgcattacctcacatacttttcacttgtttgtggtgagaacacttaaaagctactttgttagcaatttttgataatacaacacattttattaactatagttatgttgtccaatagatctcttgaacttattcctcctaactgaaactttgtatcctttgaccactttcaaaattgtattcagtttttgtaatgtagcattttatgtgtcttaataaaagtcaccttcttatcccaaattgcttcagctaggaacctggtagtcatcattaattcctccctgtttatgatctcccacagtcactccatcgacacgaccagttaggaggttactgaagaagtccaggcgaaagacggttggggtggattggcacattggccatgaccagtcctgggactctggagccagacaacctgggattgaatctcaggtccttcgtttgcatgtgacctatgtgtaaccttgggcaaagtcctgtttctctttctgccttggtttcttcagcaatgtaataggaatagtcatagtaccttactcaagggattgttgtcagtattaactcagttaatatgcctaagatgcttagaacagtgtctggcacatggtgctagcagtcactattgtttttgtttatctgctctttcagattgtaaactccatgacagcagaatatatgtttcactaccatatgtccagtttctaccatagggcctgacacatagtgggtacccaaatattttttgaatgcatgcacgaatgaagaaatattaattcatcaatatataaataaataaggaaggaaggaagaaaacagtgattgtgagctatgtttagtaagcaaaaccaggattatgatatctaatcactttcacaggatagaattattgatttattttttggttgctcctaagcacctggttggtagaagctttcatgtattgtaacgctaaacctgtaatttttcagggctggggagtgggaagggggttttcatttaaggacgtctgtgctttaagaatattttaggtttgtggtccagctgacgttttctttattttaaagttggagaggctgggcgcagtcgctcacgtctgtaatcccagcactttgggaggctgaggcaggcagatcacctgaggccaggagttcaagaccaccctggccaacttggagaaaccctgtctctactaaaaatacaaaaattagccggccgtggtggcgggcgcctgtaatcccaactactcaggaggctgaggcaggaggatcgcttgaacccaggaggtggaggtttcagtgagccgagattgcgccactgtactccagcttgggcaagagagtgagactctgtctataaataaataaataaataaataaataagtaaaaatataaagttggagaaatgagattcaaagaaatttttctaaagtcagaaatgttttctcatgtccaaagtgggataccaactcttgttatatatttcattgtgggtactcttaatatataggtttgagtgtagttcagcctctatctgattgccagcgagcaaatatgttttgagtacctagtatgccaggcacttccatgtgctaaggatacagaggggaattcaacagatcccccacaccccaccttccatggagctgacagttggaccagctaggcagaccaactgtccagatgtttataacaaagtgtggcatgtttacaaaagaggaagcacatagtgcagtgggactacaaagccttggaacctagcctagcttagggagtcagggagggcctcttggaggaggtggcatttaggctgtgtttcccattggaaaaaataatagtaaagttgcatttagatataccacctatatagttaacctgctatcacttcctgagagtcattgtatattcccctctgtttcttccagggtcctgaaggatttacgtttgtgttacatatttgatctgcatataggtattcatgcgtgtagcccttgcactacagaatatattgtctgctggtcttacatcagttcagttctcactttgagagatacttattggaaaagtatggaacactagtactggaaaaggatcgcacatgcgatctctagattcattttctcatttgctctttttttaaaaaaaaactttattgacatataatttacatatcataaaatgcactcatgtatacaatttcagtgatttttggtaaaatcacaaagttgtgtgaccatgataattcagtttcagaatatcttaatcatcccaataggatccttcatgccttagcccctggccaccatgaatctactttccatctctgtagatatacctgtcctagacacttcatagaaatggaattatacaatatgtggcatttttgtgactggctttcactgagcatgtatgcttagtgtaatatcttttaggttcatccatgttgtagcatgtatcaagttcgttcctttttctactgtatggatagaccacattttgtttatccattcatcagttgatggacatttgagttgttttcatttttttgctgttatgaataatgctagtatgaacatttgtctgcaaatctttgtgtggacatctgttttcaattctagtctagggtagagtgtaaattgctgagttgtatggtaagtttgtttttaactttttaagaaactgcaaactgttttccaaagtggctgcacaattatacattcccaccagcagcgtatgagggttaggtttgccacatgctctccaacatatgttagtatctgtatttctgataattgccattctagtgggcatgaaatggtatttcattatggttttaatctgcatttcctgaatgatctataatgttgaccatcttttcgtgtgcttattagtcattcataatttcttttggtgaaatgtctattctaatcttttgcccattttaaaattgaattatcttattatggagttatatatttatatatcctagatacaagttctttatcaaatatgtgtctgcagttttttcctcgtcattttcttaataatgtctttttttctctctttttttaagagacaggttcttgctctgtcacacaggctggagtgcagtggtgtgatcatagctcattgtaacctcaaacttctgggctcaagtggtcctcccacctcagtcttctttttttttaattttgacttttattttagatacagaagatacatgtgtaggtttgttacatgagtatattgcacccaggtagtgagcatagtacacaataggtagtttttcaacccactccccatctttccacccaagtagtccatcatatctattattctcatgtttatgtctgtatgtgttcagcatttatttcccacttataagtgggaaaatgtggtatttgtttttctgttcctgccttaattcgcttaggataatggcctccagctccatccacgttgcaatttttttgtagagatgaggtctcactgtgttgcccaggctggtcttgaactcctggcctcaagtgatcctcccaccttggcttcccaaataatgtcttttgaagcacaaaagttttgaattttgataaaatttaaattatcaattttttattttattgtttgtgcttttcatatcatatcagtgaaaaatttacctaacctaggaactcacagattttttcccctaggctttttttttcctaaaggttgtataattttaacctcatagatttaggtctttgacccattttgaactaatttttatatatatagtattaatttttatatatagtaggaggtcagagtctaagttcatctttatgcatgtagatatccaattgtcccagcaccatttgttgaaaagattgtcctttcctcaattgaattgcattgtcatctttatcgaaaatcaattaaccataaacacaccattttatttttggactctcagttttgctccattgagctatgtgtctatccttataccactaccacactatctttgtagtgagttttgaaatgtggaagtgaaattcacccagctttgttatttttcaaggtaatttgcgatcttctggtggttttgcatttccatgtatgttttaggctcagcttgtcaatttctgccaaaaaatttgctggaattttgataggaattgcattaagtctgtagagcaatatggggagcattgtcatgttagctatattgagtcttctaatttatgaatatgggatgtttctccatttatttgggtcatttcatttttctcagcagtgttttgtaattttcagtgtataaatcttacattttggtcattcatttttcacagaacgagtatttgtacaatttggattttttcatacaactggcacttagaaaattctggtgaggtgggaatccagagcttggagaagtatggcttctcagtggtcataataaaaggggcctgagaccagtgggcagaagctacagggagacaaactttgactctgtttagagagccagtgttgtcctgctgcaaaaaggatagacctggaagatggtgagccccctcactgtctgtatttaaacaagagctgtataatatcatggtaagaagcttagagaccattcgttctcatttctgagcatgcattgaaatcagatatggaacttctttaaatcaaaatacctcaaacaccccctaaacctacaggatgagaagttacaggagagactctagacacctgtactttaattggttccccaagatgactctgaataccacagtataagacctgtctgctgttgaacagagtgttttataaatgtgatggataattggacttgtattgtcccttccaacattggcattttgtagtggcatgagatctggataaaatgagtgtggggcaactgtagacatgccttaggtatgtaggaaacacaagcagagggattttccttggacaagcaggcaggacctgtggttctgtttgtggtgggcttcatatctcattcggatggttcagtgccaatgctgaatctcaagcaattctgaaaaaaatcttcctaatggtgccatgcaggtcatctgattttaagtgacctgaatgcattagagaaattgagcaataaaatcagtggcttgtgtctcacacttcaggtttagcccattatatggcagatacttatttcccattttaatgggaatttttaatagtaaggttgctagctccatgaaacctgtcttccttgcagtcttttaattcttattaaaagaaaactgatagagtaaggttgcttactttttggcctgtttaccaatctacagtgccacaaagattgatgatgatacattatatgatgatactgttttattactatcattatgtgttttgctaaatccctgggagagtcttctaaataaatcagcatttatacaaggacaattatgcctacccttgaaattttcctctggtgaaaaccctatataactgtaaaattgctgtagaagtgctcattttacaggcacctgggaagctgctagagggacaaataaggaagttatggtgtcctgtgcctttgctggacaggacaacttcaaaaacagtgagttctgtagctacttttctagagatattttttctattttgctccagcccacatatcacttgtcttcctaacctccatccccaatatgcactatttttatagcaagagatgatgcaaaggaaaataactaattctaaagggctcataaaaagcagcatttgtacagcttttgacagtttataaagggttttgacatatgcatgttctcactacattcttacaacagcccaattttagaaatgagcagcagagaggtactttgtgctggattgtagctaggtggaaagtgaagttacctacccaggtcttctgtcactgaatctaccaaattcttctccattatgcttcctcattactaccagacaaaataaatatatcaggaaaagttggtaaatagcaacaaataatgccttagaattaatttgctacaatatacaaaagcaaacattttcagtaaatttttgcttcttatacatttataaaacatggcaagataacaagcatgtaggaattctgttattcatgctcatgggaggacttctggaatgactgtgtgagagctcaataaatcttcttcccaaaacacagcaataaaattggacaaagttgtcaaaaataactatttagtctctgtaaattgatgaaaggtcaattaaattgaggaacatttattaaagaaaatctactgaatcttggtaagaatagtaggtgtctatggcatttaagattgctcccatccctgccagatccatgttctggatgatttatcacaggcaggtggaatagactgcagtgaccaccagctcccatttctcccaccagctccagaaataaaccattgtgtttatggtcagttgattttcagcaaaggtaccaagagaattcactggagaaaagaccgtatttttaacaaatggtgctggagcaattagatacccgtatgcaaaaggatgaatttggaccttaacctgacaccatacacactaagttaactcagattgtatcagagatctaaatgtaagcatcaaggctataaaacacttaaaaacataagaaatattcataactttgggttagacaagtgttttttagatatgataccagagccacaagcaataaaataaaatggataaattagatttaatctatcagagtaaaaaaattttgctctgccaaagacaatgtcaagaggctggaaagacaagctacagtctggtagaaaatatttgcaaatcatatatctgacaaaggacttgtatctagaatatataaggaacccaaaatgtataagggaacccagaatatataaggaacccataagaaaacaacccagtttttaaaatgggcaaataacttgaagaaacatttctctgaagagggtattaggattgccaataagtacacaaaaagatattcaacatcattagccattagggaaatgcaaatttaaagtatggtgaaataccactacacacctattacaatagaatggctaaaatgagagatattggcaataccaaatgtggatgaggatgtggagcaactagaaccctcatatgatgctgtaggggacagtggttaaaaaatggtatagttgggcatttgggttggttccaagtctttgctattgtaaatagtgctgcagtaaacatacgtgtgcatgtgtccttatggtagaatgatttataatcctttgggtatatacccagtaatgggattgctgggtcaaatggtatttctttgatagaatggataaagaaaatgtggcacatatatacaatggaatactatgcagctataaaaaagaatgagttcatgtcctttgcaaggacatggatgaagctggaagccatcattctcagcagactaacacaggaacagaaaaccaaataccgcatgttctcattcgtaagtgggagttgaacaatgagaacacatggacagaaggaggggaacatcacacaccagggcctgtcagggggtagggggaaaggggagggagagcattaagacaaatatctaatgcatgcggggcttaacacctagatgatgtgttgataggtgcagcaagccaccatggcacatgtatacctatgtaacaaacctgcacgttctgcacatgtatcccagaacttaaacaaaaaaaaaaagaactgaaaaaaaaaaaaggcataattactttgagaaatggcttgcagtttctcataaagttaaagatatgctgcacatatgaccgagcagtcccactctgggtatttaccttagagaaatgaaaacatgttcatataaaaacttgttcatgggtgttcatggcagctttatttgtgccagccaaaagctggaaagaagccagatatccctcagtaggtgagtgtttatacaatggaatacaacttagcagtaaaatgagatgaagtgttaattcacacaatacttggatgaacctcaaaggtgttacgctgagtgagagaagccagtctcaaaaggttacatactgcatggttccatgtatttaaccttgcaaagacaaaactgtattaatggaaaaaacaaaacaaaacaaaacaaaacaaaaagcagtggttgctggggttaatatgtaggatgaaggtatcagtgtgaagagatagtacaagagagttttgggggagtggtagaactatttggtatccttgttgcagtggtgcttacatgaatctatatgtgtgttaaaattcatagaactgtacaccaaaagaaaaaataattcattgtataacaataaagcaaaaaaaaaattttaagacaacatcagagaaattttaaaaaagaaaggaaaaatataggtcatagatttggggaaaatattttcaaattgtattttcaataagggacttctatccagaaaacaaaaagtttgggttttttttttaccattcaataagagaacctgagttaaaatatggcaagagatttgaatgacgagacatttcaccaaagaagatatacaatggcctataagcacataaaaagatgctcagcatctttaggcattagggaaatgcacattaaaactacaatgagatacctctgaacattctctaaaacaggtatgatcataagacaataacaagtgctgctgtgcctgtaaacaaactataactctttttttttttttttttttgaggcggagtttcgctcttgttgcccaggctagagtgcaatggcacgatcttggctcaccgtaacctccacctcccaggttcaagcgattctcctgcctcagcctcctgagtagctaggattacaggcatgtgccacaacgtccagctaattttgtatttttagtagagatggggtttctccatgttggtcaggctggtctcgagctcctgatctcaggtgatctgcccgcctcggcctcccaaagtgctgggattacaggtgtgagccactgcgcccggccaacaaactgtaactctcatgtgttgctggcgagaatgtaaaacaatacatttttcccaatgtagtttggcagtttctaaaatattaaacatagatttatcatatgacacagcagttccactcctaggtatctactctagggaaatgaaaacatgtccacagacttgtatgcaaatgttcatagcagcgttattcacattaacaaaaaagggaaacaactcaaatatttattgattagttaatggacaaataaaatatgatacactggtacagtggaatactatttggcaataaaaaggaatgaagtactgatacatgcctccaacatagataaaccttgaaaacatactaagtgaaagaagccagacacaagaggctacatattgtatgacaccatttatattaaaagtccagaaacggcaaatctatagtacagaaggtagattagtagttgcctgggaattggagtaggaagcaggaagtgactgcagatggaaatgtttcaaaatcagattgcagtgatgattgtgcaactctgtgaatatactaaaaatcattgaatagtatactctaaaatgggtgaatcttatggtatgtaaattgtaccttaataaaattgctttttagtttcaccacatattcaaaacaaggaacaaaaatattttgaatgaattctccttgaaactaatatatcaacgaataacacagctgcataagtagcagaacaagtagaacaaggtattgaaagggctgtaatattcactctcaaaatccaagtcatgtaaattacccccaaacctgaaaagtcattgtcaactgctggaatccattggattctctttattcattgaattagaaatagttatcaccatcttcaaacactgtgtaactggatgcaaaatgagatactttcttttcttggaatttcagatgaagctttaaaactcataacaacccctactgtgctgtaaaaaactccacagtggtggccacactgatcaggtgatcacctaccctcagtaccttacataagaaaaaatgaggtctcactaaagaacagtgcacccacgtacctgttctcctccgtaacaaaggcttattaacatagacatttaaatattgtagctgatggatggctgtctagaattaaacctcaccatgtccacttgttcagctctcctcccaacagcctcagccacaaaaggaaaactggcaccagaccaatgggagctggtttctttaatgaacccgtgggatttttaaaccacacgttgctctcatgattatattccttcatcatactaccaagttttggataagcacatacataaactatatatatgcaagtacagttgtgaagtgagtttttttcctatccacaagttgaaacagtctcgaatttttgcccctttggagtttaccatcttgttttaagccacatcaaatgtcaaaggaatttcatccatatttgctttctgtaaaagttcaaaacaattctttcattagtaatgtacctacgaaatcagtgattgtctctttatcagctgacattttatgtgctattttccctggcccaaacacacagtaggttatttctctttgtgatctagaacactaggctgttaatctggtcaaatcattagtgcttctgttgctctccatcattttttatgaatactgaactttctgaagctttcaaaaaaaaatctagtgcatgttttaattccttgtagctatgaccacttcacagttccctgtcaggatgtctccgagatccagcagatgaaaatatgctgttcatgttttctccaagtctttatcattttctcacctaattaccttcctgcagttctaatatcctattctttcttcaactggaaaacgccaaatatgaacttaatatcatgccatggaatatagtggtaataaatatgaatctaaaatgtctggggaggtacccaaactctaccttgagttagtggtgtaccctgtggcttggtatatttttggtcaaaactgtcaggatggtgttaaccttacatctctgctgtggtgttttgtgttgccatattttaaccacaagggggcagcatcaccaccttcgctgtctcccttccatctttaatatgagcgcattgggcccagggtagagaagaaaaggttttacaactttaaaaagcaatattcgtcatctggtgatgattgtaaatatgatagtgatgattactggaagagagttgaagaatgtttcctctaattgaggaatttgtctacaaatataaaccctctcttgttagagtagtattcatgaggacctttgctagtatgcttcagtctttccattagctctgctaataatgaggttagaaaagtcaagaaacaatgagttacatgaagcaggttctgatttttaggagaaagatagtctgtaaatgacttgttttggcttcctgatgacaatttaagttaaatcatgttccaaatagctgcctccagatgctgcagatcatcctgtattatgatgagtgttgaagggctagagtcgtctttgccatgtaaaacttcgtcagaaaataactgtctaaccagggagtgaaataagactaaaaagcatcacagagttccatctagagtggagagagagccccccagagccctgaacagctccactgccaccaatctcattaccatcacacctgcaaaggggccactgctgccacagctggccccagtcaccattactgtgaccgcaaacatgagcagtgaggctgagacacttggcatgacaccatgggcagaggcagagggagtggcagcctgcaaacaggacaagaaggttatcccagtgaaagtttgggaacagtaagatggttcagtgtaagaaatatatatggtttcgtccacaggaatgacactgggtgagatgtatttgtatgccagattgtcataaagaagaataacccccaggaaacaccctggcagtacaggggatggagaagctgtggagttcgatgttgaaggagaaaacggtacacaggcagcaaagattgcaggccctggtggagttccagtgccaggcagtacagatgcagtagactgaagccattatagatgttatctgcatcatgggggtcttccacacggtcaccagcacaattaccagaacaatgagagtggggaaaagaaggattggagagttcccttaaacgtcaggccttacagcacacagaagatgcctcctcccttgcagagaccctatgattcttgaccagagtgttctaaccctcctgtgcagagacaagtgatggagggtggtgacaaccagggtgaaggagaagaggtaggtcagtgagacagattacgtattggggttacagaccacgaatctccagggcccctcctcacctagaacagtaatgaacacccaaggccagcagccatgtcattgtaggcaccccccaacttcagttaccagcacagacacccagaaaaccctgaaccacaagatggcaaagagactgacagctaggaagtccgttgccaaggctgagcagagcaggacagagtaaatgccagccaaccatttctagtgtcatctggtttgtcatcctacaggaataaatgaatataaattccagcaataagacctgaacaaaagattggttctgaagaccttaagtgactgcttttggcccatttaccagacagctagcactatctgagttatggagctttcattacttttccctacagacatctctttttggtaatgataaatatgtttttttaaatatgttttttaaaaggtctggggccaggcatggtggctcacgcctgtaatcccagcactttgggaggccgaggtgggtggatcaccagaggtcaatagttcgagaccagcctagccaacatggtgaaaccccgtctctactaaaaatacaaaaattagctgggtgtgatagcgcatgcctgtagtcccagctactcgggaggctgaggcaggagaattgcttgaacctgggaggcggaggttgcagcaagccgagattgcaccactgcactccagcctgggtgacaaagtgagactctgtctcaaaaaacaaataaaataaaataaaaggtctggtttttcttatatgcctttaaaggttttcaaattgtttcgtatctggtcagattgagattattaagaaactcatttttaagttgtaaaaaaaatcaagttgttttattacaagtcaacaaactgcaagtatctgttaatatgggtctataataattataataacacaacacagatgcagattttggctcaaagaactatatttttctagattttatattttatttgctattcaacaatgtcttgtgagttcttatatatcttggtgataagagacattatagaacattacacatggaagacagtaaacatcgttctttttctcagcaactttctccattaatggcaaaatgagatgaggaagcaaatatatcattctgtcttttaatattgccagcaaagaactgaatttagagagaagtctgaaattttccttctagagaattatagaaagtgtctgatagtgatttatggctggttttttgtttttgttttttaatctttcactcacttttacttgggcatgtctgactcgtgttcaggtccagggagccacactccttccttattcacagaattgaatgcttatacatgatcttgctgtttttatttttcctaatgggagagccctactaagaagggtatgagacttacatacttgtagctgatgatcttagccatctcatagctacagccccaagaagccagctctccagcccctgaatcctgactcctcaaatgtacactgcagtgtttcacttcccaaggggtgtaattaccttctccatgataccagtgtttcaaatgacctaagcaaaagaatttcttttttctcccctttcctctgatgtgtggcaaagcaagttacatttatagcaactggaaattccagtgggctggtccttgctggcacatggcaacaggactggcttgagggatgctgctgagtgaaatgaaagagctcagcagttctgctttgtgctgtcctggccagaaaaatctttgctgcttgtcatcccatcttcctccactagaagcctgagaaatgagacatgctcaggtgttaaaagtggtcacagggctggctggatgtggtggctcacacctgtaatcccagcactttgggaagctgaagccagcagatcacttgaggtcaggagttcgagaccagcctggccaacatagtgaaaccttgtctctactaaaaatacaaaaaaaaaaaaaaaaaaaaaattagccgggtgtagtggtgggtgcctgtagtcccagctacttgggaggctgaggcaggagaattgcttgaacctgggaagcggaggttgcagtgagcccagatcacgccactgcactccagcctgggtgagagagcgagactccactcaaaaaacaaaaaagtgctcacagtgtcataataccactgaaggtactgtcccaccttgtcctcctggtggccgagcaacttaaatcggaccagaatagatggatgcttaaccctttcaatcctgaaggcccatgcagtttctcctaaaatacataccccatgcccagtttctaagattactgctgcatttcttagttgttgaaagtcaactatgccattatttccacactttctctatccttcctcaggcctgatgagtttttttccactctttcagggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtgagctggggacactcagccatccttgtcctgacatggttgttgattccctgacttgtcttgaccttgtggagagaaatccttccaaactcctggattatccgtaacattcctggctctctgttttgttacaaagctttttggtccatgatgaggagaaggaagaaccagatcttcaacttgagcctttcagctggtgacctttgtgggtctgttagcatctgtagctgaaatgggccactgattgtgcaatggatttgtacgtccccactcagctcatttatccagccaccatctcctctttgctatgtctcttatccttcctgtggtttagggatgatattgctactttcttaaaataagattgatttcacttttagcttaatttattcagtattcagaagggtaattcttagttcttcgtggttcttttgctatatcctacaaatatttgagtgcttactcttatcagtgattgatgccagaggcttaatgaatcttcaggggaagaagaagatcttgttgtcttagaatttgagtccaagcattttcatttaatgttggggtagcaacatagtccacatgaaaaagcattatacatcttgcatgggtaatttccaggataagcaagagatctgtattaattgatgtatactccattaccttatagaccagggtttatcagaaggaagccttctgtatagcggtcttgggagatccaggttgtggggagcccattttaatacagcacaaggctaaggtatgtgaaggctgacagtgaaaggcagagtgtagcctgtgctccagaaattaaattattgttgtttttggaatctaccctaatccttaaggaaaattattctctacctggagcattaaacatgaccatcttttctgtgtccctaatggcagcactctttgctctcaactcttcataagaaagcatggggttttcataaacattctgaaattcagcgcaactgagaatgaaatccaatgtaaataccacacttaatggctgtttggaaatggcagcttgagcccttcatattggataagatgggggaaaagggaaatgataccaacacatttccatctttcaggtcataatagaagatgaagctgacttttgctctcttatctttagaaacctgtttatttaaatcccctctgtttaaaattttgctgcacaaagcaaaggtgggagaacaaacaaggccaggatgattgttgctagttgagggaaaagagacatgttgacatagcttggttgataagaagagcattggactgagtgtcagaaaacccttgtgctagtttgtacattattgggtttggtggcatccagcaattttcactgcctttgggcccagtgtcctcatattgggtaggtactgtccaaggctccttctcattctgacattccctgctttgcagaacactcttatctttaacaagaagagagaataaagcatcatttgaaagaacctacttttattaggctgattaacacctccagtttctaaacaaataagttaacatttaataactagaatgaaggtttaaaaataattgaaacacaagccaaataatctaccagcgtgaacaaattctttaaaaagattagcatgtttatagcatgcttaatttttttctggatatgataaaactttgttctctaaaagtttcagagtaatttgattaatttccctgtatcaaacctacaagaaatttcagttcctttaaagttgcccaatttatgctgatgttcaggagccactaacatcactggtgactttgatttaggctacatcaagtgtcacagaaggctggtcactcaaaagagacttaaattcagcacaattttgtctataaaggattctgtgaggggatccaggaagttaataaagaatcacgacggcatcttttactgcagttgagtctttataaacgtgtgatgaaaatcaagatttttttttttttttttgagatggagtctcgctctgttgctcaggctggagtgcagtggtgcgatctcagctcactgcaacctccgcctcctgggttcaagcgattctcctgcctcagcctcccaagtagctgggattacaggcatctgtcaccacacctggctaatttttgtatttttagtagagatggggtttcaccatattggccaggctggtctcgaactcctgaccttgtgatccacccgcctcggcctcccaaagtgctaggattacaggcatgagccaccgtgcctggccaagatgtttttatgaaaaacactggccagaagctttctgtgagttctcaaaattgcatgaaactgttgtgtcttattatgttttaaaacagcacaagcaagatcataagagcaaaagtgttatggggagaagagcatgccagtccatggggagtcatagcttctcctctgggataagtccatgatttttcacatttatgttgtttgctctaaatattcaaactttagtcaatggcttcaaatattaagcagatattatagcatgaattggagttaaataaaaaattggcttttttttctttttaaactttcaggtaacattcgatccagaagtatttttcaacattcttctgcctccaattatttttcatgctggatacagcttaaagaaggtaagatgtttttgccagtatttctgaaatcatgtgaatctctgtgttaatttacctgcataattttctagttatttttcttctcccagattgcttattactttgttctgcacccactcagagactatagttgacttctcatcaatgattcatttctgttttaaaatctggaactcccatacattgccagtgggaaggtaaaatggtacagccactctggaaaacaagttggcagtttctaataaaactaaagttgaaattgccatatgacccacagtttcactcctaaggatttatcccagaggagtgaaaacttatgttcacgtaaaaacctacacatgatcgttcataccaagttgtaatagacaaacactggaaacaaccaaaatgttctgtaataggtgaatggttaaacaaactatggtatatccatgttgtagagtattactcaacaataaaacagaacaacctattgatacacccaacaacctttatgaatctcaaaggcattatgccgagtgaaaaaaatccaatctcaaaaggttgtatactctgtgatttcatttatataacattgtagaaatgacaaaattataaaatgggaaacaaattagtggttgccagtgaatagggatggtgggggcattggggtgggggtgcttataaaggggtagcatgagggacatcttcagggtgatggaacagttgtgtattttgattgtggtggtagttatgcaaatctacacatttgattaaatgatagggaactatgcacacacataatacatataatgctagtttcttggttttgatattgtaccatagttatgtaagatgtaaccattgggggaaactgggtgaaggctacatgagacctctctgtacttaatctttgcaacttatgtgaatctataattattccaaaataaaaagttttaaagaacctaagtatccttattactgagggtcatcgtgctagacagcaaggttgggccagagcttctagttatttaaaatactaaataccagcctgggcaacatagcaagaccctgcctctacaaaaagcaaaaaaattagctgggcatggtggtacatgcctgtggtcctagttactcttggaggagtctgaggtggggagcttgagcctaggagtttgaggccgcagtgagccttgattgtgtctctgtactccagtctgggccacagagcaagacccggtctctaaaaataaataaataaataaataaataaataaataaataaaaacaaatgccagatatctttacaaatatttatggatggctccctccctctcccattgtggtaatattgtctgaaaattaagcctcctcaaaggcaggtaacagctgtggaacttgtttcagctctctttctgaatgaggactaaaggaaaccctttcagtgagtctagagaagagagattttgcctgacaataaaactcaacaacatccttaggatctagagaatgcctctgaaactgataaactctagctaggtcagttgagaaaaagggaggaaagaaacaaattacctgtattaggaataaaagaagggactttactacagacccttcagatattaaaaggataataagggaatactatgaacaatttttgtgccaataagtttgacaacatcatgatgagatcttgccgtgaaaaacaactcaaaaaaagaaaaataaatctggcaacccaggtgaaatggacaaattccttgaaagacataaattatcaaaactgacctgagatggaaagcttgaacagacctatattaaagaaattgagtttataatgaaaaacctttccacacacccatatggctttactggtgaattatatcaagcatttatggaagaaataataccaatcttatacaaattctttcagaaaatagaagagggaacacatcccaattcattttatgagaggatgccggcccatcaggctgggttttctatcaaagccactctgcacttttcagatgatttttaaacaatttccagccaacataaatatagtttacagagcatttgctgtgtattaggaacggatattctttatttctgtttttacatccattctttctaatcttcacagaaactctgtaagaaggtgatggtgattgaagattagttcacactgcttctcctccaggtttccaactcatcgataaacagatacaaggagttaacttgtgattaaatgattgatttatgatcctaagtccctggtaaatgcatgttggagtatgtcacttagcctttagtaatggggctgcttacaacctacctcatgaattgaggacaggtaccctttagccaccaggtcagtcacagttacacctaaggaggctgaaatggagagatcctagaaattgttgggcctgcgcaaagctgcctctttcgctcatagcatggaggctagaggagcaagaacaattccccaccttgcacaacagggtcaagactacaagtcagggtcaaactcacttcctctttcagagatcaagtgacccctccttactgcataaccttcagggcaggaggggaagggggagaggaatggaacataagttctgtctgcataataggtgcttgaggaacggaggctgtgtgtttctgcacgccagcccagtgcatttgtgtactcacatgtagagtgtcctgtgttttactgatgatgaatctcagctcagaatgattaatgatgcatatgaggttacgtagataacgcgggactgagtcaaggtgataccctctctgtctgactccagggcccagagttgttcttttgtgccttattgcctctggatttaggttttctgtacaaaaaagactatattgttttcctgactactctggggttgccagggtcatccgaatttgtatgtcatctattgacatgtagtagataggagatggttattatgggtataaataacgttattttttacgtaagtggagaatttgggaactcttcttcagatcaaatgggtgatgagtaatttgatattttacataactaatcttaatgtataatcagttatagttgttttaaaatgaaaccaaatcatgggttgtgaaagccactatgatggttgaaagacattttagtttttgcagaaccttccctttatcagcaccattttctcaaaagaaaaacacctcacaggctttgccagttcccaatcaatttgtttttgagatgctagcctgagtgggaaaaaactcacaaattggtttttctctgctctcacactacagtaacaacacagaagacttctgtgattaaatgtgggagggatttctccccaccagcaaacaagcaatgaattctgcagcggacaccagctgagtgtcctccagatcagttctgacactatctacctggagataatgccagatcccacggaaggctcagtcccgcaatactgcccccccgccccacctcagacacctgtcacaagtctgggacttctgactgcctggcttcaagttggggttcccacgaccccctctttgagtttcattacattgctatagtggctcacagaactcagggaaacactcatatttaccagtttattataaaagatattacaaaggatacagatgaagagatgcataaggcaaggtgtggagaaaggggcacggaacttccatgccctcccgggacaccaccgtccaggaacctccatgtattcagctgtttggaagctctcggaaccccatccttttgaaccttttacagaggtttcattgcataggcgtgattgacaaccatgtagaaaagtgattggacaaaagggatgtgatgtaatgctgatagactgagtggggaaacccagcaaggcctgtgtgttcagattcttcttggcctctctgtgtggcattccttcctccccagtgtggggcaggatcccttctgaaatgagggtcttatgacctacttcaaaaaggcaggagaaaattagagtatatttttagtttctatgccctgccttgggacaaaaaaggagcagatgaaaggagggcaagagaaggtcagagggattctatttttttgctacctgcttctgaggcctaaagtgcccagcattacaacaaaagactgtaacaagagctatgggagtttatgagccaggaattgtagatgaaaatcagtacatacacatcataatatcacagctagtctttcaggttatgaactattagtttagtctctttcctttttaaattgtccctataaaagcacctaaatagttggtccttaatatggttgccatctctgatgaaacctgttgtcagtgaaatgtgtaataaatacttcaccatttaacggatggtataacattcagaccctctggcctattcacatcatatagctatcatgcagacctgggctttctgacttgaaaaagttctcattggatttagctttgattttgtgctaccactcatggtttgcttagagggccttggcagggaaataattcacccatagaagccgttattggtggactcccccaccaaacacacacacacacacacacacacacacacacacacacacacacacacacacacacacattcactctctctctctttctctctctctctccctcactcacacacacatatacaataacatgttaaaacttgccagtgaggaatgggaggggataggatttcccaaggagtagcagtgtgaggcttagaatggtacagctaggaattgggatatcaggtagattttcaccaaagcaaaacttctcatcctggcctgtcttgggcttatatttttgaagactttgccagggcatgccatcatctccttttgtctcttcttgtcattttataattgaggaggaaaagtaagggagattctgaactagtcatggctgtattgtaaccaaataagggtgggatgaaagatctaggattttaccggacacctcctgtcctttctttcccaaagagaagtgggaatcgaagagctgggtagcagggcagcttgcgcagtgagagcatgatgctttggggtcaggagaccagctttccagtctgtggcttggtttggcggacgtgtgacttgaaacagcttacatcatgcctttgagccttgggttctctcgtatatgatggtccaaataacaccttccagatagatcattgtgagaattggatgggctaatatatgtgaaaacactttgtgaactatgaagtatacgtttaagtactagacataatacacaaataggtagtatagcttttcaaaatacagttaagtttcagctcacatcagcagatatgaacgggagatgggtaatagtgtgtgtgtgattttagaatatattatgaaagtatttttggctgcagatttacattcctaatttttttgctttggctaatgtcatgaatatgtatttatctaatttatattcagagttaccatgggaatatctacccaaaggaaagctgagtggcaaggaaaagcacatctgggattgaaatttgttcttggatacctcacaagttcattcatctcatgccttgttcttggtacactcctagccctccctgattgaagccctttatggagattttaaagggaagcagactcacagctgttgattttttggaaatatatattttctcaaaacattggtgtataaatgcattcgattaaaaacaaaaaggcggttatttaagaggcaaacataatgtgtccatcttatgtacaggcagcaccctcattcggtgcctgtcagcatggcaagcccttgaaggattctctcctgagcaggtggcttaggggcagcaggcattccttaacaccttcttcactgactcagataggggcaagcactgggaaggccctgtgtctgggatgcagaccagaggacgcctgcagccctttgtctggtcatgcttcatggtagctgcctgatctaggctgggttcttcttcctgcaccctgtttttttctgatgttgctcagctgacatgctggggctctcctgccttttaaaaaaattttaggtaaagtattcctggcccttgtttgatcagagtgttgggagatttttgtctgtttttgttaaatagttctgattgtcaaatgagaatggcttatgccttgaggaggcagaactgtgtcttaggatcccaagaacaggcagaatttcctccgtcaaaatatcccacaggcctaatgacttgtaagaagtaaatccttccaagacaacatggtaaaacaagtaaatccgtgtgtgtgtgtgtgtgtgtgtgtgtgtttatatttttaaggtaaccaatgaatgtgcagaagcattgaaaggattgcagttttgccactttctgaataatttctagctgtgatattgatatgtgtttcttcttgtataaacttggccatcttaaatggaactatctgtttctcatttctccacatccatctctattgtccctctttcccaggcttcagacattaatctagatgaatataaggagacgcttcaggttccatgagcagatatttaggactctgttttctgatatcaaattaagcagaaagctcatgacatagcaccttcacactttatttgttttaaacttctatctgtgatgatcttctgaggtaccaccagaactggaagtgacgtgctgtatcactgagtaaaatggtttgggttaaatctgtaaaaatgattggtctactcacacacacacgcacaacatatacacacacttaatgtgatttaatgtaatcatccagagcagttttgtctgaaaatttactaagtccttgcttacttgctcagtacctggctgtatagaagataacttaaaaccatgatgtctaaggttaaataacaccatataggagtaacttcagttgttacttgatgtaatggaaacagtaagtagagttccactttttagagacttttaatgtgtttcttaagctcattgttgaaaatcacaatgtgattcctgggttttgtttgtttgttttattcagagacactttttcagaaatcttggatctatactggcctatgccttcttggggactgctgtttcatgcttcattattgggtaagtgaacctttgtcatataaccaaattaacacacgttccatagggatgagatccatttgggtccacagagtccagtattttgatatttttgatgatggcagtcaggatcaagagttacaccgttcagtatggtagctattagccacgtgtggctatttaaattaagatcaatttacatgaaataaaattatacccagcacccagatcttggtttctgttatcattctttgataaaaacaaccagagccccttgcagaaatggctaattctagggctggggcaggaaatatacaagatgaaaagggagtatcttgtaatgccagaaagtaaggaagtactcagaaaacagacagacaaaagaatgtgggggatgtcaaagggacacaagagccaacctgaaagcccctgtaatggtcaaagccgccccacaatggctgaagaacgacaaaacaaataacattgcattagattatccccaagagcataaagtaagtatcactgagtccatatggatataagtaagtgattggatgaataaataaatgggggaaagagacaaatctcctgtgcagaagaattccaaatactttatgtagatacatcccccctcaaggaggtggagctcagtcccctcccactccctctttgactgtgggctgtgcgtagtgacttctttctgaagagtacagtacagaaagcaggaaaaaagagtagctttacagtggagaaacctgacaaatactacctcacccaggtgatcaaggtcaacatcagcagtggtaagtcacgttgatagtatgtaccttgatatttgtgatgagaaggatactctacctctctggttgttcacttaaaaccacattacctcagtctaaccatgagaaaaaaaatcagacaaatcctagtcgaaggatattctacaaaatatctgagcagtactccttaaatctgccaaggtcatcaaaaatgagcaaagtctggcagggcgaagtggctcacgcctgtaatcccagcactttgggaggccgaggcgggcagatcacaaggtctggagatcgagaccatcctggctaacatggtgaaaccccgtctctactaaaaatccaaaaaaaaaaaaaaattagccgggagtggtggcgggcgcctgtagtcccagctactcaggaggctgaggcaggagaatagcatgaacccgggaggcggagcttgcagtgagccgagattgcgccattgcactccagcctgggcgacagagtgagactctgtctcaaaaaaacaaaatgagcaaagtctaagaaactgtcacagtcatgaggagactaaagggattggatgactaaacgccatgtggtatcccggataagatcctggaacagaaaaaggacattaggttaaaaactaagaaaatctgaataaagttaggatttttattaattttttaacaattagctagaaacctggagataatagcaggggccttttgtgccatcaaaaaaggaggggctttgacttatcctttaagagatacatattattgaagaatgacactttacataactggcattagtgatgataggaagcaaaatggggaaaaggctgccggagaagtctattgtttaggtcacagactggtggaaggaaatggagaggaaggtcttgttccaggaatgtttaaagggtacatgaaagaagcctttgataagcaacaaagggcaaatcaaatctgtaacatacaattcctgtgaaaagaaattgagctggttaagtgtctagaacagtgtctggcacacaataggcaagcattaagttatagctgtttcttctcaaaatgattccattctgtgaatagttcttttgcttctagcttagctagtccacccttctaagcatttgagacacaaaggtgggcaatggcatcaagaatctcattattagagcattggctgtagggtataatgagtcaagtccatggttatttttactcctctaacccctgcagctgctgctatcactgctgctgccaccacacgcacacacacagacacacacacacacatgcacgcacagatacccttgtaacatgtactagaccttttcacactcctcactcctcccaatttgtaagctgtcctgtaggaaatgtgcttccaccaagctgaaaaatttaacttggtagtccctcttagcccacgtcatagtctacatagcataaggagggctattgctggcctgcctgacccatgcaaagagtgaaagcccagatatcttgatgggtatatggatgttctaataggacatttaaagatattcgcctctttttcctttttttgaaataattcttggcagagaaggcaagatcctttggatctttgtgaccaacccatttttttctctctagttgcatccagtctactgatttctctgactttaaatgcattatcttagagtcttatgagttttgtagcaacttattgctacaaaaacattatgccaggttctgtctcttcctttcctctgtattacccagttgcgtcaaatgccttagctttgttgctaattgaagactgtgcttcatggttgctttagttgttagccagtacaacttttaaaaatgaaatgttcagatatttcagcaagatgacattaactgcaaactattacttgatgccaaagtcctgctggcaatgtctctggtaagtgtgaaaccatggcagctgcctgttgttttcataaatctctaagagcagcattctagtgctattctgcttgcgtgtttgctaagttacttatttttttctcctgacatagtttaccttaccttcttacagaaatctcatgtatggtgtggtgaagctcatgaagattatgggacagctctcagataaattttactacacagattgtctcttttttggagcaatcatctctgccactgacccaggtatttggctttgtgtatttgtctttattattatgatattccattatttaaatctttaaaagttcagagcaatcattaacttttgttgcagtagggagaatgtagtatttatttgcatggcatggtggtggaagaagtgaccaataggtgggtctaacagacttagatggcttttcttttcctttttccttttttgagacaggatctcactctgttgcccaagctagagtgcagtggtgcagtcacagctcactgcagccttgacctcctgggctcaagcaatcctcctgcctcagcctcccaagcagcgggactacagttagatggcttttctaagaagggcatgcaatttccttttttattattaatttttttttattgttgtaaaaatgcctgacataaaatttactatcttaacaattcctttttttttttttttgagacagagtcttgctctgttgtccaggctggagtgcagtgacacgatctcggctcactgcagactctacctcccatgttcacgccattctcctgcctcagcgtcctgagtagctgggactacaggcgcctgccaccacgcctggctaatttttttgtatttttagtagagacagggtttcaccgtgttagccaggatggtctcgatctcctgacttcgtgatccacccgccttggcctcccaaagtgctgggattacaggtgtgagccaccgtgcccagcctatcttaacaatttctaagtgtatagttcagtagagttaagtatacccacatcattgtgaaaccaatccccagaaccttttcatcttgcaaaattgaaatgctatacccattaaacaacaacttcccagtcccccttccctgcagcccctggcagctacctttgactttctgtctctatgaacttgactactgtagatacttcatacaaatgaaatcatacagtatttgtccttttgtgactggcttatttcacttagcataatgtcctcaaagttcatccattttatagcatttctcataatttcctaacctttaaggctgaataatattccattgtatctgtatagcatgttttttttttgttttgttttgtttttgagatggagtttcactcttgttgcccaggctggagtgcaatggcacaatcttggctcaccgtaacctctgcctccgcctctgcctcctctgcctcagcctccggagtacctgggattataggcatgcaccaccatgcccggctaatttttttgtatttttagtagagacagggtttctccatgttggtcagtctggtctcaaactcccaacctcaggtgatccgcccacctcggcctcccaaagtgctggaattacaggcgtgagccaccgtgcccggctgtataacatgttttgcctttcgtcttagaatgactaatttggtcataagttttacacttagattttcttctttcccagtgttgcccttttgccttcttttatgtaacatagcatttgggttaaataataccttttcttagtagaaacacacatgattatctgtagtgaatgtaatttaatttgtaaactccttttgtgcggcattcctgcaggactgtgcactgtgacatggttttctattcatcaatcccttgccttgtatttttcaagtgttggttgaaccaattcttacaagtgaattattacaccctcccttgcagctcaaaacaaacaaaaaagttctcctttccaagttgaaacctataatttgatcagtttgcataaagtagttacagctattctcttccttagtgtcatctattgagagtacaccttagggaaagaagttctggagaatgagctgctcctgtcctcacggtagagatagaaaggtctgctcaatgtctccaatgccctctaatattctgaacagtaataaccttaaagatattaagataccccacttgaccatgccccttgggggtcctctccatcagtgctatctttctgtgaagatagagatgttctataatctgcaagtccattgtggtaaccagtagccacatgtggcttttgagcacttgaaatgtagggtaatgcaatagggggactgattttaacttttatttaatgttaagtaatttaaatgtatatagccacatgtggctaatggttaccacatcaaacagcatagctctagacagttgtgtggttctgaagaatctcaatgttcaaaaaaaaaaacattgacctctcttaccctcatattttattacaaacaccctgagtaaattagtattgaagacttggctgtcgaggcactctggtttgtgaaaaggtgggatttggagtcacaggccttgggtttagttctagccctaccaatcactgatcgggtggcctgggcacacattgtcccctcacatcagtttcctcatatataaagtagaaatgatggcacctatctcctaaggctattgtgaagatgaaatgaaacaacacgtgtaaggcactgagtgtaccctgtctaaattatgctggtctgtgtccacatctgactcaggcagagatttctcagttttccttatgtttaaaaaataaacaaataacagatcatctctgaagccaagcatgtttccaaagagaactctgaaaatcagctttattattttaatcctgtgctgtctgtgactgtctccagatgtgtgtctgtggagaaatagatcttcataagtctgagaaaggtatttagtctgtccgaaaatgtgtttctaagtatactcatctataattttattactgacatcttactagtaccactaacaagtaaagggaagttagtttaacataaagattattgatattgtttcctgagctatcagtgttacttcatttaattggatagagaggcttacttttctagattatctttgtaattgtttacttccctttaatgtgtctatgctatggtagagaataatggaaggcattaccatgctactccattttcatttggcctatgaagactggcacagtaagggctttatagaaatggaagttgtagaaaattgaaagtttaaacttattaagcatcaggacattaactttaactgctttttaaatagaaatattcctgaaatgtagaatgtttttgtaaattagaagtgttttaccagcctcctaaaaaatctgttgtttgaaaacttgggtcataaaagagataaaatcttaagtgcagagttaagcatcacaagaccagattgacttctagtacctggtgcatcaaacaaaaattctgatattggcagcctgggcaacatagtagaacttcatccccacaaaaaaattgtaaaaattagctgaccatagtggtgattgcctatagttccagctactcggggggctgaggcaagacgattgcttgagcccaggagtttgaggctgcagtgagctgtgatagcaccactgcactccagcctggatgacagagcaagaccctgtctttaaaaaatgaaacaaaaaactttatagtgttaggatacagagtggtattgactgatatgaaggaataagaatccttgtccctgattactgtacttggcttgagacatgagtctttggtcttctggtcaaaggtgacataatatatgtgggatagtgtaggctgcactgtgacagggagccttctccactctgtggtcatgtgtcatggctgccatgtgccatctttgtgggcttttgttttagacggatccacaattaaagaaaaaaaaatgcatttgcaccccatggtgccttcctaggcagccaccagagaacacatgccactgcactccagcctaggcgacagagaccctgtctaaaaagaaaagaaaaatagaaacctgtgagtcaggctgattgactcaaggagtacaaaggtgatgaattaaaattggggaaatgacatcatgatggttcacaggaagggcatgcaatttccttttttattattaattttttattgtggtaaaaatgcctgacataaaatttactatcttaacaatttcttttttttttttttttttttttgagatggagtcttactctgtcgcccaggctggagtgcatcctttgggacttggttcaaatgtgccacctgcctagtcactctttctagactccattatctgctccctcagctctttgagttaggtctgttttgtacatgtcagtgcttgccactttgtactgagtgctcacaagtgctaagtgcccttgactacatggatgatgtgtccaagaaaagttagttgaatgaacacatttaggtccttgagtttttccttcttcatatatctgccattcttttgtttttcccactgcctgtacccagtgatctttagttagttaattgtgatttctcagtctgtgttcagttggaaatagctgtgaccctgctcaccctgatttcaagggtcctgctgtagggaggagggcagtttgtttcatctctcccattaaagaccacttagccagtctgtcatccccatcccatcgtcttccagttgtcagcacccacatcccacccccgtggtcaggcacagacttgctcaggaggggcacagaacggttcctgacctgttttgtgagataatgagcagggagaatgagaagttgaaacagatcagtgctatgtacgtgtttattgttattattattaattatgcttttaggccaggtgtggtatgcttctgtggtcccatctacttgggaggctgagatggggggaattgcttaagcccaggagttccaggctatagtgaactataatcacaccactgtaccccagcctgggcaacagagcaagaccctgtctcaaaaaatatatagaaataaaaataaaaataaaatttttaaaaaatgggcaaaaccaaatgatagtgtcagggaatgtgcatttgtgtgattaaattatagggaaaggcaagaaaatgatgactataaaatttagtttagcggttccctttagtgaaggaagaggcttcagactgggatgggacatataggggactgacaaagttctatttcttgaacaggggtgtggttacaagactggttggcttataataactcactaaactgaacatttgtttggcttggttttctaattgtatcaattagtaatgcttttggctgcaaagaacagaaaaacctggctaatccctgcttaaacaaatagatatttatcttgggtaccagtactgggctgatgtcccggcttccactacaatcataaaaaatactacactcagtctttctgctccactgttctggggtttcagtcacacatcagttgccccatggaggcaagatgactgcgttggtgtctggcctctctgccctcttcctgacaggaagaggtaatgctttctgcaagggaagctgggaaagtgggtttttagtttttgcagttgtatggtagaaaccatcaagagagagggtagttgggtatgagtgttgagagagaacacagctctcgtgcatgtatctagatcggtggttctcagtcaggggcgatattgcccctgcccccacccccgtcattattattttaagcaacacacacaccatgtttcaaaggcttggcacaaagatggaatttataaaatctaattaatcttttttttgagacagagtttcactcttgttgcccaggctggagtgcaatggcgcaatctcggctcaccgcaacctttgcctcccaggctcaagcaattctcccacctcagcctctggagtagctgggattacaggcgcctgccaccacacccggctaattttgtatttttagtagagatggagtttctccatgttggtctggctggtctcgaactcccaacctcagggatctacccgcctcagcctcccaaagtgctgggattacaggcgtgagccaccgcacctggccctttttttttctttctttccttttttttttttttttttttgagatggagtttcactcttgttgcccaggctggagtgcaatggcacgatcttggctcactgcaacctctgcctcctgggttcaagtgattctcctgcctcagcctcccaagtagctgggattacaggcatatgctaccatgaccagctaattttgtatttttagtagagacggggcttcactgtgttggtcaggcttgtgtcgaactcctgacctcaggtgatccacccgcctcggcctcccaaagtgctgggattacaggcgtaagccaccacgcctggcccttttttttttctttctgtttttgagacagagtttcactcttgttgcccaggctggagtgcaatggcgtgatcttggctcactgcaacctccgcctcctgggttcaagtgattctcctgcctcagcctctcaagtagctgggattacaggcgtgtgccaccatgcctggctaattttgcatttttagtagagacggggtttcaccatgttggtcaggctggtctcaaactcctcacctcaggtgatccacctgcctcagcctcccaaagtgctggaattacaagcatgagccaccatgcccgaccaaaatctcattaatcatttttataataactttgttattttaaccttggctctattgagccagagaaatcaaagagatttcaacccactggtgaagccaaatcacattgattgtcattattttttgaagttctgtaacagatactttcaaagtgtgatgggatcacagtggaaagcatagtgttttggtgcaatatcattagactcaagcatcatatcaaagctccttcagataaggaagattgcggttttcatttctgccacagatagataagtctatctttgactcccttgctatctcttgaatcacccagtcccacccaagataggaattgcctctataaatctgtaatcagtgatttaaggtcagaaaccaaaactaatttctgtgctttcggctcacttttcagtgactgtgctggcgatatttaatgaattgcatgcagacgtggatctttacgcacttctttttggagagagcgtcctaaatgatgctgttgccattgtactgtcctcgtaagtagcagtgtttctgctggagaagagacaccccagtttcctctatgctttgggctaaattcagaggcttatcttaaatgtattacatattgaattgggtgtttttctaaatgagatttatcagctttgtggataaaattacgttgctttgtgtgcccagcagcaatcagaatgctgacaccagcgtaacatggtggctgcagattaaattaaatgaatttaccctgggcaatgctggctgcagattaaattaaatgaatttaccctggccaatgcttgacaaaatgtagatagacctatgtttgtcgatattttcaagtaccatagtgtaaaacctgtgcagtcttttaaaactgtctcttgtttttaaactttaggtctattgttgcctaccagccagcgggactgaacactcacgcctttgatgctgctgccttttttaagtcagttggcatttttctaggtatatttagtggctcttttaccatgggagctgtgactggtgttgtgactgctctaatatcctttttgtagtttcagctcgggcctgggtatgcgtgtgtggcattacactttcaaaaagaaagttctcagctgttctttcaaattggaattttacattgagtgttccactggggcatgatggctcctgaaatatgtcactttggtgaagcatgacggttgggtccctagctgagagtctgagaaaatgtttaggaatgcaaccctagacttcgctctgtcttcacctttgctgtttctctccctttcttgtgatccagttggagcatcagttttagaggggtgaaaagagctgaggaggcaggaggagactgagaattagggactactggctgggaagtactttagccccagctagctgctgccaactgctgttcccggccacatggtgttatgtggcgatagctagttagtggccttccgtaagcaaaggatggcccagtattcagtttaaacaaactaaaaaaacagtgtggaaagagcaggcatcccttccacagatgtggtgagtcctgcatcatatcctctttggtgggcattactatgtaatttaaaccacatcattccaacatgtaatcaatatggaaaaaaataacaaaattatgataaaaataatttttttttctttttttttattattattatactttaagttttagggtacatgtgcacaatgtgcaggttagttacatatgtatacatgtgccatgctggtgcgctgcacccactaactcgtcatctagcattaggtatatctcccagtgctatccctccccccttcccccaccccacaacagtccccagagtgtgatgttccccttcctgtgtccatgtgttctcattgttcaattcccacctatgagtgagaatatgcagcgtttggttttttgttcttgcgatagtttactgagaatgatgatttccagtttcatccatgtccctacaaaggacatgaactcatcatttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccaataatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatggccattctaactggtgtgagatggtatctcattgtggttttgatttgcatttctctgatggccagtgatgatgagcattttttcatgtgttttttggctgcataaaagtcttcttttgagaagtgtctgttcatgtccttcacccactttttgatggggttgtttgtttttttcttgtaaatttgtttgagttcattgtagattctggctattagccctttgtcagatgagtaggttgtgaaaattttctcccattttgtaggttgcctgttcactctgatggtagtttcttttgctgtgcagaagctctttagtttaattagatcccatttgtcaattttggctttcgttgccattgcttttggtgttttagacatgaagtacttacccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctaggcagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtatcatgctgttttggttactgtagccttgtagtatagtttgaagtcaggtagcgtgatgcctccagctttgtttggcttaggattgacttggcgatgcaggctcttttttggttccgtatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattgcctgtgggtttgtcatagatagctgttattattttgagatacgtcccatcaatacctaatttattgagagtttttagcatgaaggttgttgagttttgtcaaaggccttttctgcatctattgagataatcatgtggtttttgtctttggttctgtttatatgctagattacatttattgatttgcgtatattgaaccagccttgcatcccagggatgaagcccacttgatcatggtggataagctttttgatgtgctgctggattcggtttgccagtattttgctgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaatttggctgtgaatccatctggtcctggactctttttgattggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtgtttctgtgggatcggtggtgatatcccctttatcattttttattgcgtctatttgattcttctctctttttttctttattagtcttgctagtggtttatcaattttgttgatcctttcaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttaatgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttattttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacaatggggtgttaagtctcccattattaatgtgtgggagtctaagtctctttgtaggtcactcaggacttgctttatgaatctgggtgcttctgtattgggtgcatatatatttaggatagttagctgttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagttgggtttcctgaatacagcacactgatgggtcttgactctttatccaatttgccagtctgtgtcttctaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagtggctggtaccggttgttcctttctatgtttagtgtttccttcaggagctcttttagggcaggcctgatggtgacaaaatctctcagcatttgcttgtctataaagtattttatttccccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccctgtcactttcaggtacaccaatcagatgtagatttggtcttttcacataatcccatatttcttggaggctttgctcatttctttttattcttttttctctaaacttcctttctcgcttcatttcattcatttcatcttccatcactgataccctttcttccagttgatcgcatcagctcctgaggcttctgcattcttcacgtagttctcaagccttggttttcagctccatcagttcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctctgtccagctttgttccattgctggtgaggagctgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaaccggccgtgtgaggtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcggaggttactgctgtctttttgtttgtctgtgccctgcccgcagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagactccatgggtgtacgtccctccaagccatgtgcgggatataatctcctggtgcgctgttttttaagcccatcggaaaagcgcagtattcgggtgggagtgacccgattttccaggtgccgtctgtcacccctttctttgactaggaaagggaactccctgaccccttgcgcttcccaagtgaggcagtgcctcgccctgcttcggctcgcacatggtgcgcgcacccactgacctgcacccaatgtctggcactccctagtgagatgaacccggtacctcagatggaaatgcagaaatcacccgtcttctgcgttgctcacgctgggagctgtagaccggagctgttcctatacggccatcttggctcttcccccaatcatgataaaaataattaatgagattttatacattcaatctttgttccaagcctttgaaatatggtatgtgtgctgggcgtggtggctcacacctgtaatcccagcactttggaaggccagggtgggcagatcacctgaggtcaggagtttgagaccagcttggccaacatcgtgaaaccctgtctctactaaaaatacaaaaattagccaggtgtggtggtgtgcacctgtaatccctgctaatcgggaggctgaggcaggagaatcacttgaacctgggaggtggagattgcagtgagccgaggccgtgccattgcactccagcttgggtgacagagcgaaatgccgtctcaaaaaaaaaaaaaaaaaaaagaaagaaagaaagaaagaaaaaaagaaatacagtgtgtgtgttgctcttacaacacatctcaatttggactagccacattgtaagtgttcagctaccacattggatagcgcagatttaaattgctttcttcacaagggcccttttgatgccttggagacgtatattgctcagtgagatctgtcatgagatgcttctatgctggccgtgtgttgaatggcactgttacaagaaggatctctggtcccgaaaggtgacaccagcacctggtagctgtctcaagaattatgcatttctttctttcctgtgccttccttaggcacctgttgtggactcaggtggcctcggtggtgcacaggggtcagggtctcacaggccttgtcttcacagccctgctggaaccaacccaacaagccagcctgacgtcatgaccatgcctctcagaaccatggccattcaaggagcacagaaaactagttgccagtttctctagaattctgaatttttaaaagaacagccttattgagatataatttatataccatacaagtcacccatttaaatttaatggcttttggtatattacatgataatttttttttttgacggagtctcactctgtcacccaggctggagtgcagtggtgcaatcttggctcactgcaacctctgcctgccgggttcaattgattctcaacctcctgaatagctgggattacagatgcgtgtgaccacacccggctaatttttgtatttttagtagagacagggtttcagtatgttggccaaactagttttgaactcctgacctcaggtgatccacctgcctcgggtcccaaagtgctaggattacaggcatgagtcaccacacctggcctacatgattaattttttaaaattgtggtaaaatatagccaacgagatttgtcatttaaccatctttacgtgcacaattccgcattcacaatgtcatgtagccatctccctgtctactttcagaattttttcatcatccgaaacagaagctctgtacccattaaacaatgtctccctgtttcttcctctctccagcccctacaaaacttgtgttccactggaaagcttaatttgtattacttaagaaatctccagcagctttagagcctccaaaaaaaaaaaaaggttgaagggaaaggctagccctttggggaggggtcctgggctagtggagtatggttcttggtggccctgatacatgtacctggagacagggtccttgacagaatgccaacgtgactaagtttaccaaactgcactgcttccccctgctggagacggcgctgttcttcctcatgtcctggagcacgtttctcttggcagaagcctgcggatttacaggtaggttttttctactcttggaccacccttcccctcactgtagtggggtctgtgggaacttgaaggaagggaagaattcttagataacagctgcacagagtttaactgttcagcaagtgtccgtatggaggattgctgagcaaggctattgttctgtcttaaatggattatttactttccaaaaagctagactttttttaattttatttttttagagacagggtcttgctgtgtcacccaggctggagtgcagcagcacaatcatagctcactgtaacctcgaactcctaggctcaagggatcttcccccttcaccctcccaagtagctaagactacaggcacgtaccacacccagctaacttctttattctttgtagagatggacaacatttgctatgttgtccaggctggtctcaaactcctgaccttaagtgaacctcctacctcagcctctcaaagcactgggattacaggcatgagccaccatgcccagcctgaaaaagtagattttaatgataaagtttatcattccaaagtcaattacatttttgagtactcattctaactgtaagtagatgttaaggtgcaaagaatctattaaaattttatttgtatatttcccttgattgctatgttattttgcaaacagtagcaataacaagcaaaatatgtgtcctttaaagggtgattttgcctctgctcagatgagtgtgaacacggtttttcattgttttgtttctgggctatttaatcattgcttttcaatatcacatttttatggtgtcagtttcatatagtattagtgaggtgaaacatgtggttttacttcctcacattctttcattttaaaaaaacattgaatttttccattagaaaattcaagtacagttctgtacataatccaggtacttaggatgtacttttgtcaccctttcaaaatactgtagcaaatctttatatgcagcattacaaaatgccccacttccttaaaatttaacagttatctgtaaatgtgtaggcaaagtcccaggtgtgtcatttgtctcgcacaacaaaatggttaccattaaccagaaatatagaagatcggggcttggataaatggaatagtactcttgatctattttgtctaaagccctagactgtgaaaaaatctaggccaggcacagtgcgcatgcctatataatcccagcactttggggccaaggcaggtggatcccttgagctcaggagttcaagaccagcctgggcaagatggagaaaccccatctctacaaaaaaatacaaaaattagctgggtgtggtggtgtgcatctgtagtcccagctattcaggaggctgaggtgggaggatcacttgagccttggagatagaggctgcagtgagccgagatcatgccactgccgtccactgagggatatataatatataatccactttgtctcaaaaaatatatatgtatataaagcattagtttgaaattcagttcattcattctaaaaacagtgaggaatatggcaaaaatttggatgggccctcacagtctctttgaaggaatgaatgctatatgccaactacagatggtagttggaggagtttagaggaggcaggagatacccttaaaactggaacaaggaggggatgttgaggtacttggctttgaaggaaggcagggttgggagacacaaaggttgagaggtgaggggttgtaggagtgttcagtagtaataggaaacttttttttcttttttttctttttctttttttttttttttcttttgagaaaaggttgccttctgtcgcccagactggagtgcagaggcgtgatcatggctcactgcagcctcgacctcccaggctcaagcgatcctctcacctcagcctccctagtagctgggccacaggcccacgccaccacatccggctaattttttgtatttttggtagagatggggttttaccatgtttcccaggctggtctcaaactcctgggttcaagcgatctgcttgccttggcctcctgcagtgctgggattacaggtgtgagccactgcgcccgacccagcaataggaaagtttcaaaaatattcaggaagttggatatgctaggcttgcctaccttaactttttgttctagcagggttttttttttcccctgcctcttttttttccattgattttttttggggggatgttttaacaggtgttgtagctgtccttttctgtggaatcacacaagctcattacacctacaacaatctgtcggtggaatcaagaagtcgaaccaagcaggtgagagagaggcttggtactcacgagttgcttgttaacacagggaagggggaactgcagggttacagcttccttttcccttctctgtgcagctctttgaggtgttacatttcctggcagagaacttcatcttctcctacatgggcctggcactgtttaccttccagaagcacgttttcagccccattttcatcatcggagcttttgtatccttttcttgttccaccattttctacatgcagagacgaccactgttggagaagctatagtaataatagtcataataataatataaaataacaataatataataatataaaccatcataaaataataattactatttctgttttgggtaggtgactaactccatgctagttcacagggtttttatgatgaaaaaaagaaggcttaagtggcatttcataacactaaatgtatttgatttaaaggactgcatgtattccaagatcatcctttctgccttttctatgtaagatggcctttctgttaaactggtgctcggcaggtgattgttttgtaaagtgctcttcttggtgaatctaaaagtcagcaaccatgtcagtctccagtgttatttttgacaattcattgctgtatgaattccaatccaggaggttccctgatttggatgacccaaaggttctgttcctcttgctcatgactacgtctgcagtatgggcagcccttcctcacactgcccagggttgcctgcaggcagtgaccctactttttctcaagcttccctgctgctgcagatcatggtgggaaagactctttctccccgcccccaccaaaaaaaaaaggagaaggaaaaagaaaaatgaagggaagaaaagataaaatagaaaaatatttggttccttggtctgggcccattgtaaatgcagtttctggaatatagacatagtttgggggattggcttctcatgtgcctaccagtggatggacagctgagggttttgctcacttggcctcagatactatgtttttattaaagtgaacttttctggggcttgatttcaagatactgagcgcagtcccctattgctggacattcacatttgccttttctgaggcctcatgattatccttagattttggaatgctggcaaaaaagcagtgtttttctcttctgggcttaatttattgtgcaggaatgactgacactcaccaagctgctggacagtgacagtggcctaatgcaatgctggaatccttctagcgtgagagcctcctacgcttaaaccagtggctcatttcttggatttccatgcttaccagactaatagctaaaaatctgcaagatcagtgtttttattcttttttgagaaagaccttgcatgttgttttgatttgtattcctagcatgacaccctgtgagagatagtgagagcacagccctgtttacagatgagggcctggcagaggccaagccgggtcctctgcagatcctaactgctgcttaccacttaaggacttttgtttctcttctgggatggaatgtactttataagcattacctggttctttctgcttaaaacaaaacaaagaaaacggaagaaaaacaggcagtgctttaccctgcaggagacagagaagatagttccgccctggcttctgtctgaaacagctgcagctcctgcagctggtgttttgccaaaacggaagctccctgttcctctggctcccacaggggttcccttctctgaccaggggagtgtgtagctctctcagttgggcactattctaagctcagcaagtaacaaaggaccagtttccctgcattctttggtttccacagcagagttcctttttccatactccttttccatttcttacatctccaaaaaacattttagctacttaggtagagaaatatctccctgggttcattcctatgagtgatctgaatgtcttttagtgtggtgaatattttaagtttccccacctcttatttgcaggctcttcctgaccattaaagtctctgatgtttacttgcaaatgaagcctgcaagcgcttatccagcaaactttttctttatagtttgactgcaggattagcaattgttttcttctagtgccttttcttttagtagagcccaacacacactgtttgcttctctcaactgctctctcctgctgtggtactttagcttatttctggactcctttttagatagatttagatagatggatagatagatagatagatagatagatatcagttgaattaaatcaagaagttacaatattgtgtttaacaagctagaaatgatctctatgaatcaggaggtgggaaagcttggccaaattagtcccattttgttgctgagaaacttgtctaggggggaactagacagtcaagcttctttgggcagctctctggactataacgaggtgtcacagcattcctaaaattctctgctcagccggaggttgtgtggaatgccattctggaaactgttggtcccttaaccttctaccttgtggtcaggttgccatcttcctgggcagagccgcgcacatctacccgctctccttcttcctcaacttgggcagaaggcataagattggctggaattttcaacacatgatgatgttttcaggtaaaaaggcgtaagtgtaaagaaaatgagttttattcagcaggtaacaagaatatgattaaaatgtaattgataaggttcataaaaagacaagcattcaagtttctggtccgtttgtatcccctgcagtgagaaatagacagatgtacatgttcagttgagttagtgttgattttgcaaaccgtactaccaaatgtgaacattctcccctaaaatatttgcatttctatttcatcactaccactcaacggacctggagatatggtgtttaaagtgcttgattgttttctagaagatcttcataacccttaagcttcctgaagggcaccagctctagaattagaaggaaaagagctcctgatgagaaagaccactggccaagtcactcaacacctcccagccgcagtatcctcccttgtaaaataatgaaattgaactaattagctgaggtcccccagctctaactttctgtggagcaaaagaaataaaatacactcatgtaagcaagagggacccaacactagaatttaataactgtgatcatcctgcttaattgacactgtctcccacatgccccccttttccctgtaaagctgagaagtctggagaagccactgaggggacaaaggacaataaagaaagctgtggaagtagagtaaggagagagcaactggcatgagtggatgatgcagtgagggtggtaagcgtcagctttatagaaatggacccaagttagagcatttctgcagaacagagggaggagaagttagttgcaaaaggctactgtgacccttaaaggcacctctgtcctttaagacagagaatgagttgcagccacctttactgccatgcagtggtcgtactgaaatcaaaccaacaggcactgctcagtaaagcagtcattttatctcatgctagcttgcctctgaacttagatacaggtacagtcttctaagatgatttccttttactctgacaaacatttattgagcatcctcttttcataagccacagctctaggttgtggagcatgcaaagaccagcctccttcatggagctcacagtccgctgcggggaggcaggtacacaaagagttaattttcttccaagagaggttggtgaattgcacaaaagaggtctgaaagaaatgtgaacaagaagagaatggctcagggccatcttcacaaagggagtggccttttagctaggcttggaagaatggaatttcaggaggcagcagtttgggaaggcagaaaagcattagcatgcctggctcgtttagggaagggcagcagtctggtttaaatgtcagatacatggagtaatgcagaaagagggtgaggttgaccaccactgccgcctaccagctgttgctgatctggcacggtgaaagtgcctggaacctggagaactgcttcagtggctggaaggacaccgccctgagcccgggagccacaaggaggcgaagtgtggtggacaggcactgcaagatactggctataagttcaacatctacttcacatcagtgcagaagagagcgatctggaccctctggacagtgccagatgccactgacctgatgtggctgcccgtagtgaggacttggcatcttaatgagtggcactctggtggtctgaccgacctccgtaaagcagaaactgctgccaagcatggtaaagatctggaggcgctcctgtgatgtcccaccacctctcatagagcccgatcatcccttctacagcagcatcagtaaagatcgcaggtatgtacccctcactgaagatcagctaccctcttgtgagggtctgaaggacacttctgccagagctctgccctttggaatgaagaaatagttccccagattaaggaggggaaatgggtactgattacagcccatggcaacagcttccccggcattgtcaagcatctggagggtctctctgcagagcagaacctgctgactgctattctcgttgtctatgaattggacaagaacttgaagcacatcaggcgcatgcagttcctgggggatgaagagaccgtgcataaagccatggaagctgtggctgcccaggataaagaaaagaggtaaaggccagcggacagactactttcgccgggaacaccttccctgcccgtcccttcctctgcccctccccactacacatgtcacactgaccacatctgtaggcatctgaagttgtagctacagatgagtaccagtggctcccatttttcatttcagccatttttctcctgcacccactgtcttcacacaatctagacaagatagcatctccggggagggcacagattttcagtccaagcccagggaaaactccccttatccaaaagagttgagaggtagggacttgggtttttaccagggctttgtgtactgaggacctgcttgagtaggagatagggaggaaccatgctaaggcatggccaatgaggagaagcaagagagcctgtttgcccccaggagccagtcctgtgttcttctgtagtcaggctactacctggagggctctagtcattccagtggaagatgaatgtaacctgcatggtgatgtaaaaaaacaaaaacaaaaacaaaaacaaaaaaaaacagtttcctccctgaccccaaaggggctggctctacttgatgagtgggatcaatcctgaattaagtttctgttgcatttattttacaaaaaaaagtatataaataatacaaaacaaaagtccttgtggagtttctagtggcagttgaaataatcccacgtgatcatcagaaaataaaccattccttataccaatatggcataagctccttgacttgtaaggggtaggagtgcctcctgctgtgtattttagaatccctgccccgccttgtttcatggcagtgaagtgcctcttgatcacgtccaagtgtgtctttcactgcctgttttctgaatcacgttttagttacttggccatgccacatgggcccagtactcattttgagcataactgtactaaatcttttttccaaatcagtataagaaaggaatgatatgcaaaaaaaaaaaaaaaaaaagggagtggggaaagaaggtgaggttggaaaggagaattgtatctaaactcataattttcaccgtttaggttacatcagaattgcccattgggcttgttaaagtgcagattgctgggcctcactgtctgattctggggatatggagtgggctcttctaacatttctgagctgccactgctgctggtttgaaaaccacactttgagaaccaccactgtaggtagagtggagacctcagagaagctccagtgctgtgccaaagagtttgagcttcactcaagagcagcagggagacattcagagcttggtgaagaggacggtgataagcttctatgtacatattaggaatatgccagtggacaagaggaagattagttggagctaaccctgtcatctaggtcaacttaaatatgctcattggcttctgtactaaaaagctgagaagtgcacagtgctgtttaatgatatctccaataaaaaatattttatgctgggagaaatctgcctatcaaaaggaactcatttgtcaaggctatgaaatacctgaggtttcactttcatattgcttaccatgcttacctaatgaaataaagaaaaatgtattatacttggtctctctctgatgcccaagttttctttgagtcagcatcccttgagaggcttaaatgttgaccagtgacatagctggctggctgtagggtgacctagatgtgtataaatatctaggacagattaatagaaaacatcaactttgttttcaatgtaacttttattgatgtcactcttctttagtgaattgtagtgaagtgctcagattacatatattaataattgtgaaattgcaaaatagaaagatgtacaaacagatatagtaggtctaagttttcattctctcgcatgttatacagtcttgcccatggtgaataaaaattaatgctagatatgtactaaagactgtagattcagtcttttttttttttttttgagacacagccttgctctgtcctccaggctggagtacagtggcaccatcttggctcactgcaacctccgcctccaggattcaagtgattctcccacctcagcctcccaagtagcagaggactacaggcacatgccatcatgcctggccaatttttgtatttttggtagagatagtgtttcaccatgttggccaggctggtctcaaactcctgagctcaggtgatccacccaccttggcctcccaaaatgctgggattataggtgtgagccaccacacccggccagattcagtctttactataaaataaattatgagcgtgatatgggaaaggaacaaaagagcttagaaggatgaactccaaaacattaaactgatggtattaatcttaaatccattaatgcagatcaggtaccagcaaactacaacccctgggccaaatctggccactgcctgtcttcacatagcccgtgagctaagaatgtcttatacagatgaatatttgtactctatttgatgtagacaacactgactttgaaacaacagttaagcaaaatatcccctccagaaagaatttccctcttttcattattagacctgtattacaacaaagtggcctcaattattattattgatttttgatagtaaacatttgtggaaatgttcgtccctttgatctaagtacccacataatattcttgattttgcctcttggcccacaaaacctaaaatctataatatctggccggttacagaaagagttgaccacccctgatgtagattgggttatgttttcacttctctgtgtggtttccccttttgctaaggaaatgctgaactgttttccacaaatttgacatactcgtacctagcctgttttttaaatttatattgactgtgtagtgcttgggttgtgttgggatcacagttttagcttatattattttttacttatttatattttacttcatgttactagcagaatcatgtaagtaataggagtgttattattctgaaaaagtgctgtacaaagcagtacaatgctttttcattgtgttggggagttttgcaaaagacagcatcaaataaaagaaaatcatgcctttaaggttcttctttctgagtaaaacaacttggcccctgaagcatgaatgaatagagtttattagccccaaatggcagcagtgcattttgagacaacattgtcatttaatccttataagtagatcttcttctttggtccccgcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcaggttggtttggaaccaaggctaattgagtatgtcagttgtcaccgttcctgagaatgttcaacaacctgtgcaggatgtgctactttagttcatggaaaccttttacagtctttggttttgtttgtgaggggggattaacaattttttttaaaacaataagtaaaagtttggagtatggggttttccaggagaaaaaatgtagtcattaaaaatttttgtcagtgcaaacatacaaagaatgagaagtgcctggatcttgctagaacagtgacattagagcaaaaatttaaaaagtcttaaagctgcgggagagaaaatagaccaagagcccctggcagagtccagtatttcatgttcctttgaaatgaaatccagactctgaagaataagctcaccagccagaaatagaggcaattagagttttattttagcatgaagctgtatgctgtctcttcttgcttgagtgtacaaaagaggtgacatttcctgggtaaccctcacctgttgcagtttcatggatgtcctctgcctgtggctttgtagctgtgtcaggacagaaggagcactgatacgagtttgactttttcaagagcgcttgaattccaaattgtgtttgtgagctccagcatcttatggtaaagaggtcactggaaataaggttcaagagacccacagcccaactctggcttgggttaaagacaagcccctcatgtctttgggcctcaggtttcctcagtgttaagtgaagacactctgccaggtgatttcaagggcacttcagctgtaggtgtcgtgctgcacatcactggatgtgctctggccacttgccacagtttcaggtctgcagagggtgaccgtgttctggaacaagaagacacttgggtagtgcaaaggtgtgaataaaaattctctgaaaagccacaaggtggcaatggtttttctttctctgctggcttttttagtttgtattctctagactgtagaatgcccgacacagctgcagagcgtacatagcttggaggagagaaaatgaacagagatctcccagtcatccttggggttggggggaagaaactaaaatttgagagaatcatctcctgtgtctggggtttttgtatagatgttaggcagagattcctgggctgccacttctgctgccagccactgccacttccacttccactgccagcttcaccatttctgggctagtgtatctctgcctgagatccaggtgggtctgcagaaccaatatggggtttatcagtgttagtcataataataagtaacacttacgttgcaggcattgttccagataccatacatatattaagataattctcataacattcttataagggagataggactattatctcaattttagagttggggaaactgaggcacaaagcagtaatttgcccaaggtcacagagctttaagtggacaagctaggatttgaacctaggcactcataccacagagtccacactcttaaccactgtgctatactgcctgtaagaagagttataaaatttgggaaggttagaatttcagtttcctggcatgaatctcaagggttggattaaggaaaagaatccatctttgagaatataaacctgaagaaaatttacagtctcttacttttaaacttaagacataagatggtaccatctttgttctatgtagcagaattagggcaagaaaaaaggtttaccctctacacagttgagaatctttgcatttggtgacctctgagattacttcctgctcctgtttgtctggtcacctagtagatgctctggatgctcagagcctcattaaatcatgtttgtttttcatgctagtttataaatccttttctcccccacccctcaaacatatacgggaccaaataattttccattgagagtagagagttgacttttgacattttgctgttgtaactgccttggagatccatgtaggttgttcatgtatcaagtttgttctgttttattgcagagtagcattccaaggtgggcctgccacattcctcctctggtccctgctgcctaattagtggctccagccactaatttaaccatttacccctcgaaggacatttggatagtttcaagttttaggctattataaataaagccactgtgaatattcttgtgtaggtttttgcatgggcataaatttttacctctgcaagatagatgcccaggagtgtgccttctgtgttggatagtaaacgtgtttagttttataagaaactgccaactgttttccagagtggctgtaccattgtacattcccaccagcagtgtatgagggatccagtttctcagcatcccccccagcatttggtattgtcagggtatttcatttcagctgttccaataggtatgtgggaatatctcattgtggtcttaatttgcatttctctcatagataatgatattaagcatgacttcatgtgtttatttaccatttatatgtcttctttggtgaaatatctgttcaagtcttttgtccatttttaaattggattgtttgtttctttgttgagtttttagagttctttattctagactgtagtcttttgtcagatacatggtttgcaaatattttttcccagtgtgtagcttgtcttttaatccttttaatagggtctttcatagagcagaagttttaatttataatttatcattttttttcttttatgggtcatgcatttggtatcatgtctaaggactccaccaagccttaggcctgaagatttcttctgcgttatcttctaaaagctttttagttttacactgtacatttaagtctgtgatccattttgagttaatttttatataagatgtgaggtttaggttgaggttttatttgccaatggctatccagttgttctagcataatatgttaaaaagactatcctactccattgaattaattttgctcctttgtcaaaaatcagttgtctctatgcatgggggtgtctttctgcactgctctattggtttatgtgtctatccttccaagaccatactgtcttgatgactatacttacgcagcaaaccttagcatcagagtgattcctcccactttattgttatggctattctagttcctttccatataaattttggaataaatttgtctacatgtaaaaaaaatcttgctgggtctttcataggaattatgttaaacctttacattaatttttggggagattgacatctttattatgttgaatcttccaatccatgaacatgatatatttctccatttatttagaacttctttgatttctttcattcgatttttgcagttttcagcaaccaagtcctgtacatgttttgttagtacttgtatcctgtcaccttactgctgaactcacttactagttctttagttctgaaagtgttttggtccttttttttttttttggtagattcttttgaattttctacatagaccatatagaccatcatggtatttgtaaatagccacagttttttttttttccttccttttcaaccagtgtaccttttgtgtccttttcttgccttattgctctggttaggattttcactactatgtagaataagagtggtataaatggacatcctcatcttgtttctgatcttaagaggaaagcattttccagggacggtggctcacatctgtaatcccagcactttgggaggctgaggtgggcggatcacaaggtcaggagttcgagaccagcctgaccaacatggtgaaaccctgtctctactaaaaatacaaaaaattagcttggagtggtggcaggtgcctgtagtcccagctacttgggaggctgaggcgggagaatggcgtgaacccaggaggcagaacttgcagtgagctgagatcacgccactgcactccagcctgggcgacagagcgagactccatctcaaaaaaaaaaaaaaaaagaggaaagcattcggtcttgccttattaactataatattagctatagggtttttgtagatgttcatcttcaagttgaggaagttcctacctattgctagttttctgagagtttttttcatgaacaggtattgaattttatcaaatattttttctgtatcaattgatatgatcatatgatttttcttgtttagcctattaatatagtgaattacattgattacttttcaaatattgaaccagccttgtttctctgaaataaaccccacttgatgtggtatattattcttttacatattgctgaattatatgagcaaacattttgttaaggatttttatgtctgtattcatgagggatattggtagtagtttttttttgtactgcttttgtctgtttttggtatcagagtaatctggcctcacaaaatgagttggacatgttcctgactctttttttttctggaagagattgtgtagaattggtgttaattatttttcttaaacttttggtagaattctccagtgaaaccatctgggcctggagacttcttttttgggagtttttcaattatgaagccaatttctttattagttatagggcttttcagatgacctatttcatattgggtaagttgtggtaatttgtgaaattggtcagtttcatttaagttgtcaagtttatgttgtttgtagcattcccttgttatccttttgatgtctgtggggtctatagtgatattccatttttgatatatcttctctgtttttggtcggtcttgctagacatttgccaattttattgatcttttctaaagaaccagctatttatttcattgattttctgtattgtttttctaatttcattttaattgatttctatctttatcaatttccttccttctgtctgactctatccagacagcataatgccattactgaaaaatatatatgtgtcagctcgttgcatttttccagatgtgtataaataatgattacataagtgtagaaactgacatttacagagattacatcaaaagaaattccctctgaaataaggtaataaaacagattaatttttctggcttgtggcttgtggtgtgatggccatgaatcatttctgtaacccaggttcttattctaaattgattcagaaaccccctgaaattcagtttggcattttgacccctgtgacctcgatatgatcagcactgactcattctttacttctccaggctactgatagaggccctgatgagctgttaagtagctgcccagaagtcagaagcccagggtggttcttggagttcaccataaataggagttagctgtgtttcttactatggctaatttcaagtctgtgtataaaataaaaatgaatataactataaatccaaagccaggtcactgctttccataaatccaatttatctttttacattggtgttttgtgattgatattttaaaacataatggcaaaatgtgcaaattgctttctgttgaaacataatatttttctcagtctcttgagtaagagttgttattgacaaaggacataattttggcaacttaaaaaatgatggtgggattattttgcctgatgagcctgtgtgtgtcctgaccacattgtgacagcatggtggccgtcttctaggagccgtcagcttcaagtaacacacacgaaatggtggagatagtgggttgggggggcggtggaacgacatacacccaggtggccaaatgaactgtaactttcacattccagggtgtagtaatataatccttcaaggacaagtaagaatgctctacttggcataatcctgttagactgagaatttataataaagctctttgcaagataacataaggaataaaggcagggagaagccctgagctctttatgtaataacatttgcaactggatattttaaaagaacttaaatatgcctccttggaatcaaaggcagtatcctataagaggaagagctgaggctctggagacgagcagcttgagttggaatcttggctctaccatttctacctttgtgaccttgggcaacttatttcacctgtatccctcagtttcctcactgattaaatggggacagtcatagtgtgaggataaaatgtggtaataaataatgcaatgaaaaattctctcatcaatgtatcatctgacacataagcacttagtatattttagctgttatattaatagtattaatcatagcattacagctgctactattattaatactatttctcaagagacaatgaatcttacattaaggaatctggcttgtttttctggtgtttgctataatttttcgatgttgtagtaatagagtctgatttaagtcacattctgaacatgtaactaattaaaagtaccaccttaagaagcatcgtgtcctcacttgcatatgtcagggaatattaataacatgagaatttgggcattgtctagtgaagtagttctcaatctttttttcgttattgccgctgctgaggagcctttaaaaactttttcctcagttacctcccccagtgaaatttgaatatcacagatctgctatgcatctctgtctgtgctgtggcactttggagggttacaaaccatcataatatctgagtggttttttttttttaacctacaagaaccaatttttatacccatgagggtgatactgcctccattgagaaaacgtggttcagtgcagtgatttttcaactgagggcaattttgccgcccaggggacatttatttggcagtatctggagatgtttttagttggccacaaccagaggaaggggtcaaaacctcagcttcttggtgggtggggttgctactagtatcttgtgggtgaaagccggagactctgttaaacatcttacagtgagtgcaccatgcgggtcaccacaacagagaattatctgacccaaaatgtcaatgctgccgagtttacgaaaccctgctccaacatgatggtaagattcaaatgcactctaagtaacccagaaattattaaggaaggtgaaggtggaccatgtcaattcaaaaggctacaagctaaagagaatagcagaagttgggttgccgactttcaggttgatcctatgtacaacatggtgtgcttgtctggaaaaaaaggccatctttgtcttcttaagtattgttgctgtttttcaataatatcatgctttttgttctttctgtcaaatatgtgtaaaaatatgtgtaaacactttaaatatgtgtaacatatttaagcaacaatttcttttttctatttttggtatctttataaacaaatgaatttctgaaaaaattatgtaaatttgttttctatgaggtgtatttcatcctctgattttattacattatattttgaggggctcatcctcattcctgatcaatcctcatttgacctggctcttgacattgttgccttaaatttaaatttagtggcctctcagcctctctgggttttagaggatggggacagtttaagagaagatatggattcatattgaaagtgaaaaatattctctggtggacatggtccagatcatttgcccagagctcctggctctcctgttgtccctgtcacactcacgttcccttcttctgctgcccagagttggcgtcgaggagccctccgaagaggaccagaatgaacaccactggcagtacttcaggtgacacaagggcatcctcagaaaaaattaactgggcctggcttttctcctctttctaacctcagatatttctctttacactatttttctcttccttcctgcgtgtgccaacccccacttttagtaaaggtgcaaaaggttgagtcaattctaatcattttttccacccctcctctgggttgattgatgtgtcagtgttcttgggattctgtctgctttccccacatttaggcaatgtattgccaacataaagcctgagttgtcaagtgtctccttttcgtacaactgagcttagtgttaagagcagctcactttcagagccacacttttcccacaaaatcctgcttgtgatctagtaaataaggctcttaattcataaagagaactagaattttcatatttcaaccatgactggggtaaggcttacaccatcttagttaaataccactgctattatagtttttcaaaatacatatttgtgtacttgtgccttgtcatggtgaaccagaagatatgaagaatgtttaaccaaaaagataaagattcctctaatgcagtttgtttcttgtatccttccaagtttatgatataactatgcttaagggtggtgatgtctgggcaagcaaagtacaaactttaatgtttcttctttcctttctgtttctctaattggcatgttttcttcctgatctgattctcggtgctgatagataaatcaaatgcaaaataggcttcaactctgttctcggcactgtgagaatatctcacttccttgagggcagtggtgaaagcagtgggacatgggtcttgggatatcactaggccccgtatgtgtactgtaatgactcacatgaaattactttaagtatttaagctcactgaaatcacacttttttctacacacacatgttcatttttggagactgactttgataccagctaaattgcagaggaaaccctttcctttgaagcatgccttcaagaaggaaagtccttcaggcaaagtgtaagttattagacttgggacatgagcaaattcagattatgatatggtgttcaaggtgttatatgaagatgtgtgtctcatattcctcaaattattcaaaaccttgaccattcagggttttttttttagaaaaaattattaattaacatggaatacttctaaactttccgagattttatggcattttatctgttaatcagaatggacaaattataccagcagagaaattatcaatgatattatcaatatcattctggtatttattcattccagaatgagcacatcagtttgcttgctttatttattcatttagtgtgggatgtccacatttatctaattcctaatgaaaataaagataattctgcccattctggaagaaaaggctgtcatttgtgttcttatgagcttagccctgatgtatcaggggaatgctaaaataagatataataaaacagcataaaaaagttccagtgtcctggatcaaaagcgttataccaggtcaggagagagatacataaagtggacagtgacctggcactaggaatttcagaaagttgggggaccctaaagtcttctgaggctttaaacctgcaattaaaatcctgtacctgggccgggcatggtggctcacgcctgtaatcccagcactttgggaggccgaggtgggcagatcacctgaagtcaggagttcgagaccagcctggccaacatggtgaaacaccgtctctactaaaaatacaaaaattagccaggcatggtggtacctgcctgtagtcccagctgctcgggaggctgagtcaggggaatcacttgaacccgggagatggaggttgcagtgagctaagatcacaccagtgcactccatcctgggtgacagagtgagactccgtctcaaaaaaattcaccaaaaaaaaaaaaaaaaaaatcctgtgcctgttctttcttgctgcccagttccacaccaaaacaccctggcccattgctttacctcctcttcccagagatcagtttggttctgggctctgccccaagggtggggctctttgtaggaagccacaaggtcccgtgtcatccttggggattggtccaagaggccctcaaccctgccagaaaagtaattactaaatcgccctaaagtaaacaaccttgaataggggaaaaaaagtgcaaaacattatttgtgtctcacggccccgatctgtttttttttttttttttttttttttttttttttttttttttttttagcagcagcaagctgagaagcagctctttgtttcctttcttagaaatctcctgttctgcacttatatcagtagcaaggccctccaagagaccccaagggccttcccacactcctctgtctgtggcagggcccaggaggttcttttagactctctgctgtcaggagtttgggctgcatttcatacttggttgatatcaagtggctgccgtgaaggtcggaacttccatggcagatataggattttcctggcatcttttttctttcccccattgcccagtgttatccatgtcatccatggcacagtatcctgcctcagaatgaggaaggtgcaaggataaaaaaaaaaattgccagatgcatagagtgccagttagtatgtttctaagccaagacaactgccctggtgcttttatagtatttgttataaatgagtcctgccattttgctttttctttctgtctttagttgttgctctcaaatgtgtgagttctcaaggctatcttgatgcaagagggtataggggcaccaggattgaaagcaggtcaggactctaattaatgatattgttaaagaaaacattattctgatgtatatttaaacagtaaggcagacgttgttcaggaccatcacgattggaatagggaccactgtgatggggttttgcagcaggggagagaaacgggtcagtggatagggaagtactgagaggaaatatcaggggcaagggggattctggctaaactgacccaataggattcttgctgaagacaggcgaaggggattagacaccacctgagggattgtggggggatgaagaatccaatcagatgttggggataggccattcagatgttgggctgtggccaaaccaacttagacaatcagacatcacctgagggattgtggggggatgaagaacccaatcagatgttcggttctggccaaaccaacttagcaaacctcttgctaaaattgggctatgctgagatggacatggaagcccaaaagtcagtgcctagttgggaagtgaattcctaggagcctgactaaagtttggtcaaggagagactctttgtcaatatgcacgtgaagtatttaggggaagtattctgatgtctgcaactttatctgaatgtatccaaagaaaaagtaagatgggtgatagagaaatggatagataggtaataaggaatatacagtaaaatgttaatggtagagtctagtgatggtgggtatataggggttcactctaaagtctttcaacatctccctgtatatttgaaaaagtttataacagaatgttagagaaattaaagcaggccagggcagaagtgaggaagcagcacaaaggaagggcccagtgcagtgagacccccattttgataactgggaccacctggtgcagaaaagcaagtggacagttgccagcatgtgttgtgttccggcggccttgcttagagtgtgagcacatgggattcatcgcccctctgaccctctgggatctgaagtggtatgcgacctctttcttatgacttctgcatgacagctttcctcaccttttagctaaccactccttatgcttcgggaagatgattagcctccaggctacttgcagcctgcatggctaccatgggccaagctaatacgctctgtttttctctttgtctttctccctggtgactttcagagttggtgttgaccccgatcaagacccaccacccaacaacgacagctttcaagtcttacaaggggtaagtcacaagagatgcttcttcctggggaagacatttgagcattcgccacatgccaggcactttacctagattccctcaatgtgatcctgacaacagccttatgaagcgtgtactgctctccccattttacagattaaaagttgaagtttgggagtttgagtcatctcagaataagtgatggagccaggatttgtccccagggtatgtgttcttaatcaacattatgaagggtgtgggctcgccagaaagagtccctgactctccacttttcaatagtggatattggttctacaactggttccgagtctatcagtggtgcccaggagaaagagagcaatacgatttgactctccagcccagggatctgaggaagaaaggagagacatcaggtgcctgaaggcattcctgtttctccagggcctgggatcctctaggtgagcaatttggaaagggcatagcagggacggcttgccttttctccatgaagtccacggccccaggtgggaaaaccaggagcctggggctggaatcatgcaaaggttcatttactcatatgtctggcacctgggctggaaggacccaaccacaaggacttctgacaggaatgtctgtgcagggcttttccatgtggcctgagctgcctgccagcatggtggctgctgggtagttggatttcttatgtgatggcttaaggttccaaaagcaagtgtcccagcaagcaaggtagaggctatatcaccttttctgacctaatcttgcaagttctacagcatcacttccgtggctttctattgcttagaaatgcattcctaagaccagcccagacccaatgggaggggatagagaccataacctctggatgggaagagtatcaacaaatttacagacaagaattgaggttgccatatcatccctgttgtgcagctgtcgggatgattttgtctctaggtctggctctttatccaggtcagcatgacctgggcaggcaaggtggggaaaggagagttatgataggggcagaaatgtgttaccaatatattatttgaccttgggagtcaataactatgtcgttcagcattgaatgcccagtgctgagcacagtggctggcacatgcaggaacctgataggtgtttgttgggtggatgagggaatgagagagatgcagcatgcaacaggcagctttactgaccacctgtgtatgttgtccatgaaaccctattcttttttttccagtcagctttgaatctgactcatcattgcacttaatcctgcagcagtctgcagcagacttcacattccataggatcttctaaatgattccatctaccaaatcagatttaataaggctggcaaaatgtggtgctgtgtggggtcaatggggtgccactgtggccttttgtggtttctttctctttaagggtggccacagcctgataaggcatttatagcattgatgtccattctaggtccctgctcaagggacacaaagccatgacctggaaagttctggacattttgggaagagttttcaataagcttcattggagatttggcacccactttaatgagctccagaagacctttgagatgatcttagaattggccattatgtcagttgggagcatgtggtctcagtgagttctctttgaaaatttgctatttgactctagctttgattaaggactttagaaaacaggagttcaggaactgagcacctcgaggctaatttagagtataacagtttgggagatcttgaaactcagcctgagaaaaccccaggggaaaacatgatggccgtccttatttcaccaaaggaaagataatggctctggtaggacatggctgccctattctaaagcatcctccacagaactgtggccagtctagattaattttgtaagaaaaaaaggccaatagcagctggatcataagatttggagagatttcatcttgctctggaccattcaaaacatccccaccccctttgctgtttcccattgctcctacctctgcattcaagcatctgtaacaggaaataagtgaaaggatttggctggtcatgtagtagaacttactatgtatcacatgagccctgcgcactgggaacactgggcttgtaattagattcagtaacaagcttactgtcacttttctgtggaaatgtttgagtgagaaagcagcaggtccaaagtgctgagggttcttgtatttagtccatgcagtaacagctaaaatagcccccacccccaggtggagtgagtctcaggaacctccctggatgggcctggatggatgaactcagtgttcctgtcagctcccagagggccccttgggctgagagcaccgcacatgtggtgttgtgaacgggctggcagccactcgcgctgcactcctaatggcaccctgtttgccacagccctagccagaagctgtgtcacagcttccccctgacctccttccttccagacctcatacacagtcatgcagagggcccctcaaagtcagttccactgaccttttgaaaggttttcaagattgctgtcatatggggaaaaacatgcaaacttcaagcttggttctccaggacaccctcttagaaatgactcacgcccttgtgcagagaggaccttatttctccagttcctcctggtctgacctcctcattctagtgagccactaacagcagggctcagtgcactctgtggccatgagaaacaggaaaacagaaataaatgggcttctcatttttgggtgaaaccctgggttcttgcagtttcccctgaaatagatccaggtcacatgctcagtgttgtcatgaaactgaaatcagaggtagggaaagtccagatgtttgttctccaccagagaaaaaaaagggcggttctctttacctcattttctaaataatcttcctaaaaacaacaaacaaaaaagtgacatttgatgggaaggcatgtcttataatgagcacaattctcctcactggtcttgaagcccaaggctataaacagagtcatggctagggagctacagaatattagctcatgtgggaaaaggaagggagctgttggctagaactttgcttcatgtggggaaagcataaaaatattgtgggcagacttcagctttgtgtcccctggtaagtttgactcattagaacaaaacaagacaaaaaaaacaaaaaacaaaaaacaaaactcagtgctttgtttctctggaggtcttggtgactttgcaaccaaaacaaaaacaaccctagctggaggcaagctgcccagccctgggggtggcctcccaccccgataaagcaggggacttttcatgccagaccagacagctgagatttctgttggccgtacatgcagacacatcattcacttccttccctgagtttacagaagagcactcattgatgaggccactttggagcagctaagagtgtgaatctgaatttatcccagtttcaccatatcaacaggacaaggtcacaagccggatattaatggagtgtggaggaaaggaaaccaccaatgcctgtgtatatgcacacgtgtgtgcgtgtctgtctgtgtgtatgtagtgaaaactgtagaaaatcagcagtttattgttgcgttcacatatgactttctgagcaagttagaatcatttgtttctgggtcctccgtgtttttttttgtttgtttttgtttctccaggctgaaatctgatacccgtaaatctgtcacctaaatctttaacttcaaacagttgcagaggtgcctttcctccagttgctactctgtgaccaccgccccccccccaacccgcccatttttttgtgcttccaagtgcctcccttggcccctgatttccctttctgctcttccttttctgttttctaaaaactcagagtcaagatcaatttattcatttatttgacaaatagttattgagcacctgttctatttcaggcattctttcaggttctgggaaaatatctgcaacaaggtagatgaatctgcatcctgaagggcttggtgacaaggtgataaagggtgagggtggagagtggcagaagcaagagagtggagacactcaggcctcaccagccccactgaagcagaatctgcattttaacagtgtctccagggaatgtgtgtacattttaccattagaaaagccctgatctaggcaatgtatagctctggagagttttaagcagggaagaaaactatctgtgtatcacggtcagagatttgactctggttttttttttgttttgttttgagacagggtttccctctgacgccaaggctggagtgcagtggtgcaatcacagctcattgcagccttgacctcttgggcccgagggatcctcctccctcggcctcctgagtagctaggaccacaggtgtgtgccacttcaccaagctaatttataaaatatttttctagagacagggtcttgctttgttgcacaggctggtctcaaactcctgggctcaagtgatcttaaccctcccaaagtgcagggattacaggcatgagcccactgcctggctgattccctgtttctaaaccctattattaccctctgctgagaaatcttggatccattatcccaatgatatgacaaaggccctgtattagtccattcccacacttctataaagaaccacctgaggctgggtaatttatgaagaaaaggtttaattgactcatagttctgcaagctgtacaggaagcatagctgggaggcctcaggaaacgcacaatcatagtgaaggcaaaggggaagcaaacacatcttaccatagcggagcaggagagagagagagcaagggggaagtgccgcacacttttaaccagatctcgtgagaactcactcactatcacaagaacagcaagggggaagtctgcccccatgatccagccacctcttaccaggccccacctccaacgcttaggatcacaacttgagatgagacttgtgggggtacacagagcccaaacataccaggcccaggccgggcgtggtggctcacacctgtaatcccagcacttcgggaggccaaggcaggtggatcacctgaggtcaggagttcaagaccagcctggccaacatggcaaaaccccatctctactaaaaatacaaaaattagctgggcatggtggcaggcacctgtaatcccagctacttggaaggctgaggcaggagaatcgcttgatcccgggaggcggaggttgcagtgagccgagatcacaccactgcactgtagcctgggtgacacagcgagactccatgtccgaaaaagaaaaaaagcatatcaggcccaaatcaagtgacatcatttatttactcttctgctccatattagttgtctgtgactgctgtaacaaattaccacaaatttagtggcttaaaacaataaagttttgtttttgtttttgtttttttttaagggacagagtttcaccatgttggggctggtcttgaactccttggctcaagtgatctgcctgtcttggcctcccaaagtgctgggattataggcatgggccaccatgcccagccaaaacaatacagttttgtcatccttacagttcagtagatcagatacctggtgggctcagctggtttctctgcttcaagtttttcaaggtgttggcaaggctaagctctggggagaagccacttccaggctcattcaggttgtcagtagaattcagttccatgtggttgtaggactgaggtcctgtgttcttgctgcaaagccagcaacagtggggcaagtcaagctctgaatctctcccgccctttcttctactgcattccttcctctgactcttttgccctccatgtcctttttttttttttttttttttgagagagagacagtcttgctctattgcccaggctggagtgcagtgatgtgatctcagctcactgcaacctccacctcccaggttcaagcaattcttgtgcctcagcctcctgagtagctgggattacaggtgtgtgccaccacacccagctaatttttgtattttcagtagagaccgggtttcgccatgatggccaggctggtcttgaactcctgacctcaagtgatctgcccacctcagcctcccaaagttctgggattacaggcgtgagccactatgcctggccctccttgtccacttttaagggcccacgtgattgtcctgggcctacctggataaccttaagtccatccacaaagccttttgccaggtagtgtaacaggatccagggattaggctgtagaaagctttggtggggtggccattattctgcctaccacatgctccatccctgaaaaaaaaaaaaaaagtaagctgttcttattagtgtaatgaccttatcttttaaaaacatcttttaatattatataagaatggaatgaaatgtaactctacacagatatcattatgcattcattctagaaaaattatttcaaaaataggactgtttgctattccccagttctttaatcagctttctttttcttcattatatttgtcagtcaatatgtatttgtctgtctcccctccccctaccccccaaccctcgccaccttcaccttctggaaagagtgctccttgaggcccaggtgctaagttacattcctctttgtgtttccagcacccagcatggtgcctggcacatagtaggtgcttaatgaatgcagaagaaatagacactcattgttacatgctcaaaaaatgataataagcagggttggtggtattttcttgaaggggcttctctattaataatggcagtaaaaagatgaaaattccttgtgtaaaaagccacacaagatagccaaatgatgttaatggctaggcgtttttttcccccaaacaaatatgtgcttgaaattacatatccagtctttggaaatgaacttaattagtaatatgagctctaactacatgccagattctgggttaaatatttcacaaatatttaatcagcacaaaaagtcacatggcaaacaataatgagtcaatatttgttgagtgcttgccacatatcagacaccatcctaagttctttaaatgaaaaatcttttacagttctaaaattaaaacctattttctctacattcacaccacttttaatgccaaatatgtagggtctttttgtataccagccagttctccaattcccaatgagtaccaactggacctcctacagtttaactcactacgtacctggagttagcgtcagatcccacaggttaaggactcagtcccacaagactgtccccacttcagacaccagttgcaagtcccaggtcgtgacctgtacttcagactgactggctataggggggggttcccaacccctcctcaggttcgataatttgctagaatgactcacagaacacaacttttaccattaccagtttgttataaaggatacaactcggaaatagcctaatggaagagatgcatagggcaaaggatggggatgggagtatgtggcgccaacttggaagccctccaaattgtgtcatttagggttttatggaggtttcattacataggcatggttgattaaattagtagccattggtaattaactcaatccccagtcctcccctcctaggaggttgggatggggctaaaagttccaatcctctaattacatggttggtttctctggcaatcagtgtccattcaagagtcaccttattagcataaattcaggtgtgcttgaaaggagcttattattaataaaaaaagatgttcctcccaccccatctactcaggaaattccaagggttttaggagttttatgtcagacaaaaaccagatatatatttcttgttctatcacaacattacagcctcataatgcccctagaggtaggtaattattaatatttccagtttacagatgaggatactgaagcacagaaaggttaggtaacttgcccagcatcacacagcaagacaatggcagcggcacagtcaggagccagatagtctcttgagagagcctgtgatatccacacctacacttcttggagtgctatgtcgcttttgaaacatttcttagagaagccacgcttctgcacaggcttgaaaggtgaatagaggttggccgggtaggtgttctgggtgggagaaggtgagaggaaaaaagaatgctccaggccctagaagttgcctgagctgaagacatgaggtgcgaacccaggttttgaggaggggcgagttgagagagcaagtctgtgctttttctgtggacggcacaggagtggaaaatccaagagtcgccaagtacagccaggaaggaggctccgcctgttcccacagtgacccttcctcagtccggtgctgttcggagcccacaggaagggctctcaatggcttctctgtgacagcagccccaatcatgtcatgaagcagttattgcttgtcttccgggtcagctttaaaaaattagttctgtcccacagaactgccctgatttccccaaagccaccatatgtggatttatctaagttcttcctatacctaatcatgcttctggcaccatctcttggaataagaagttgtttaacacccttttcacaaagttacacctttgatttgtcctgaatttaccccttgtagcctctaagcgttgtttcttagttcttacatttcgggatttgctgtggagtctgaggtcactttatcttattcatggattgcaggcatatctttccgtagcctgagaagaccttttgttagtttgctgtcaaaccattcccttgctttactcattttaattgtcttttttggggcttatataagtctcttgtagctttctttttttaaatttaacttttaacttccggggttcttgtagctttcttgagattaaatggcaagaaattaagtagtccagtgataataaatgctttgtggttttgcagaggttaagatgacagagtagggttcattgttttcatcattgatttaagggaagaagcggaagaaactgactttggggtactcgttttgtgcctgatggtttaatagtatccttcctgatgatgtttatcgttgtgctggctttttccttagtaaaattctacaggcacttagaactgagaacttagagcctattactttataaagaaccatttgattttttccattatatatttgcctatcaaaaaagtcatctgctacttttctactcagtcatgtggcattttggaatcttcccagagttgtcattgggttagcaatcagtcaccctgcaaatggaggcatttctgtgctctctctcttgctcatgatttataaaaatgtaaaatcaaattggtctctggggtctctccttgtttatatttcctcatccacagaagggcccatttaactgagccatttccatatccatcactaaacattcctgaaataccgaggggattcaatttttaaaaataatctttgctgttggaaactttaggagtgtattaataaatagtgcttgctaatttctctccttctcttgtctatgtgcttctcaaagatctttgattaattatttgatgttgccattgcgggtagaatttacattcaccatgatttaaaactacttgtaattttggttcaagttgtatttggtgattgtcaattgtccctcacttgcagagttgcctctccctgtaatattaaagagaatgatgataataatagcttcacaagcagtctgtgcttgcacagccctagtagtaccctcaaattgctgcagtcagtctgagttttatattaactgtgctgcttctgatacttgcacagaacagatttcctaaacctcaaatgaatgtttgattttgcaggttattttgaaagttacacgatggggatgtttaaactggaagggcatgagagtagcaaggaacttgctacttgatggtagataaaataacagaattgttagttcgagctcgtttctcctgcccactgatcccaccttcctaaagctggtggggaaacaagtaccttaccacctggagcacagtgtaggtccctgggtaaggaccacagagaagccttaactagtttgtcaggatactcaacaatatgtggtttccacaggcctactttggggatgaggattggaaagttgcttttacaaaaagcttttaaaaatattcgctataaatcaattttggcctgttagtatctagagtattttagggtaattaatctgctgaaagacactttgaggaaaattgcaataagaatgccaaaagaaatgttgttccatattaagtttgagctatccacaggcataacccagcctttttactttggagactgatttttctgccttttgagtttaatttctgctcaaatgctacctcccaatatatctttgaaactttgctgacatgggatgtttgactatgagctccagagctatacaagttattaaaaaaggttttttttcccctttctttgagatcccttttgtacaactaagcatgtgccctcttgtttgttcctaggacggcccagattctgccagaggaaaccggacaaaacaggagagcgcatggatattcaggctgtggtacagctttgatcacaagtatccttttaagtagcatcccctgtgtcggtgaaacattggggatgaaatcttgttgaattgtcggtgaatgacacctgataagtaaggaaagatgcatgcttgggacagggatagcccatcctcttatggaacgtgtgcattgagcattcaaccataggtagtcctggtgagtatctctctggccaagaggaatgtttgcatatccttagagtaaccagcccacagcctggtagactcatgtggctcttaagagctttgtgtccagggaactatgcctttttaggtgattagattaaaattacgcaatgaatcgtgctgtggtcagaaaaggaagtagaacttcagctgttaatccatatggggaggataattcctattggatgaactcggccaagtctgatcttgtatgatctgatactggcataactgggccacatgcagggcaaaccctgttccagtagattcacttggtctcaagtgaaaattaaaaaccaaaatgttaaaccctcatggttttttttgtttgttttgtttgtttgtttgttttttgtttttgagatgaggtctcactccattgcccaggctggagtgtggtggcgcactcagctcactgcaaccttcccctcccaggctcaagcaatctcccacctcagcctcccaagtagctgggaccacaggtgcatgccaccgcacccagctaattttttgtatttttggtagagatagggtttcgccatattgcccaggctggtctcgaactcctgggctcaagcaatctgcccacctcagcctcccaaggtgctgggattacaggcatgagccacttcacccaacccctcatggtttcttaagttgacatagtcatcaaatgggcaggtggcttattatatatggtctttggagacgccaaaactgttaaaaatttattgaagtatagtagatatacagaaaagtacacaaataataagtgctcagtaaattatcagaaaataaacacactcatttaacaccaaacgaatcaagaaacaaaattccaaggctgggcatagtagctcatgcctttagtcccagtactttgggaggccaaggcaggtggatcacttgagcccaggaattatagaccagcctgggcaacatgatgaaaccctgtctctacaaaaaatacaaaaattagtcaggtatggtggcacacacctgtagtccagctacttgggccctgtctccaaaaaaaaaaaaagaaagaaagaaaattgccaaacccctcatgccatgactcaattactaccccttccccctccccaaatgtaattgctctgttgacttctagcaacacttaatagttttacctgtttttcaactttctgtaaataggattatacagtatatatattttagtgtctggcttatttggcttgacattatgtgtataatacagccatgttgttatgtgtagttctagttcatttgttctccttgttccatagtatttcttatataaatatatcacaatttattctattattgatgtacatgtcttttgatgtacatatacatattttttttggtaatctacccaggagtaacattgctgggtaataggacatgggtaggttcaactttagaagatagtgccagttttccaaaatagtggtactactttacacagtcacttctagcatatgagagttccagttactccacatcctaccaacatttggtgttgtcagtctttttaattttagccattctattgggtttgtagtggtatttaatcatggctttaatttgcatttctcagatgactgatagggttgagcacctttgcatatatttactggccatttggtatgtttctttgtgaagtgcctgttcaagtcttttgcccatttttctattgagttgtctgcctttttcttactgatttgtaagagttctttgtgcattctggatatgagtcttttgctgatcatacatgataaaaatatctgctaccactttgtaacttgccttttcactttttttttttttttgagacagagtctcactctgtcacccaggctggagtgcagtggtgtgatctcaactcactgcagcctcttcctcccgggttcaagtgattctcatgccttagcctcccgagtagctgggattacaggcacacaccactacacctggctaatttttgtatttttagtagataggaggttttaccatgttgcccaggctggtctggaactcctggcctcaagttatccacctgccttggcctcccaaagtgctgggattacaggcgtgagccaccatacccagcctcactttttaaatagaatattttgatgaacaaaaggtcttaatccaatgtattgatctcctagttagtattttttatgtcctgtttcagaaatctttgcctaccccaaagtcatgaagccaatttcctatgttatcttctagaagctttattgttggtcttctgtgcatctctttttttttactgagtgacaagcatgggcaattttttctctagaaaaaaaatctagagataatttgagatgctctgcctaacatcatcatccttcagagatgatttaagcttatatctgatcagtggctaggctaggggtattagcaattgcagatcactttaatccaaacaggaataaggatgatttgatgctgggccctagttcctgtgagagttagtcttgactgttttctctttaccctttattctaggatccccacctaaagcctggtttccatcttcttcctcagtaggccctggactttcttttttgtcaggttcactctatctttgtgactctgccaaatgctctgctctgtttcttaggtgcctttagggaaactgtggctcaccaaccacagggctcacctctttggtttcctcctctcaaattccacccctcttcactgccttggtagctttctgaagccttcaagcagatggttttgtcttattttattttgtctagcttttctagttgttctcagtggaaaggttggttcaaattaccttgtttgctactaactgaagtagaacccccagggatttttcaagccatgtggactattagaatccagaatgcatattgcctgctggtctcagaaaggatgtaaagaaaatggaagagtatccaccaggagagtgacacagtgctaaagtgagaaactgatcctctgaagaggaacaggagttatctctaaagtttcatctgaatctaaattttagtgactttgggatttccactttttagtttggaaaaaaactaaaaaggagagaaaactgtaatgtaagacaaaggtaagtcttgagccaatttgtccagatgattttattaaagaatgttaagaacagctgcaacaggtacttcctgtgtcaacagatcaattggtagctgctaattttttcttcaagccacagatacctaaagaaagttagagacactacctggagagggcttggtagagaaacagatcttgagggcatcaaagatttttctcttgagagtcactccccacccaactttggccatggtaggagtctgtacctgcctgatgaagagaaaaactaaatagagacatgagggactaattaaacaattatgtactttttgattaatccttagagagttgaaaggctttttcagtcatgatactagagaagattattagaaaaaggagtaaatcaaacaaaaaattcttgaaaattaaaaacaaggtttctgaaattaaccaaaaaaatgtaatggatagctaataacttgaatatgatgaagaccaaattgttgatctggaagatagagttgagaaaaaaaaagtccaataattatagcaaaaagaaacatgtaagaggagagtttcaagatatggaggtcagaatcagttggtccaaatcatttgacaggatctgaaaggagaggacagagactttggaggaaaagtaccaaagaaataatggaagaaaaattcccttagctaagaaagacagttgtttccagagtgcaagggcccaccaagtgtgagtaggttgaatggacacgttcgggggcattccataactacaagagaaaaagagggaatctttgaggtttccaaagataaaaacaagcaacctccaaaaagcaagaatcagacttctcatcgacaaaattggttgttagaatacagttgagcaatgtcttcaaagttctaggatgaaaaaaagaagtctgaacctagaattctacacccaaactgtcaatcaaaaataagagaatgaaggagggtagctttcagacatgtaaaaattcagaaagtttagcaccatgcagaccctgtaagaaggaagaaaaataacataaagatcaaacaaaacaaaatccagcaaaggggacagtgattgttataactcagaagaagtgaacaaagtcaaaaagaaaagatcttttatttggcaagatactcaagggttctcttctgactgacaaaatttaaatgacagtgtgttacatttccttttatattgctccaaccactttgcttggttctccagagaacagcattcatgcaatgatgttatattacaaatgctgcttactggtttttgtttttttgtttttgttttgtttttttttgggggggtgggttttttttttttttgagacagggtctcactctgcactgatcatgcagtggcacgatcataactcactgcagccttgacctccctaggctcaagtgatcctcccaccttagcctcccaagtagctagcatgtgtcaccacaccctgctaatttttgcttttttttttttttttaagagatgaggtttcaccatgttgcccaggctggtcttgaatttctgggctcaagccatctgcctgccttagcctcgcaaagtgctgggattacatgcctgagccactgcatccagtctgcttactggtttttaacacttagactcaatctatacacaaagcataaaaaatctacttattagttataaagtagaaagcaaatgttatatatctccagtataaagttaattataataaaaattgggaagaaaaaattggaaaaaagagacaggagtgtaaatgagttaaacgtaccatccttactaggaaggaaaagcctcagactaaagtttataaatcaagaaatgggggagaagtgtattatctaaagttgtaatgtaattaccagaacaactagagtgggatagaaagacttgatgttttattttgtcccatccaacaatttgaatatttaaaaacatatatatagcttactggttatatatatatatatatatgtatatgtatatacacatatttcttttctttttttgaagaagttgtcatggggccttctggagaggaggaagggggagcttgtctttggagtacctgaggtggagaactgaaaagcagtctctgagttcccctggcctcctgcgtatttgtcattctacagatctgagcctctgtcatcttctgagccaaagacacaagaaaactgacaggcctgtagggtctcttcccaaattggaggagcgcctggtctgcatctctccctgggaatgtggttcaaggacagcaaaggggagctggttccgcgtataaagagctccaggccgggcgcgttggctcacgcctgtaatcccagcattttgggaggccgaggcgagtggatcacgaagtcaagagatcgagaccatcctgaccaacatggtgaaaccctgtctctactaaaaatacaaaaattagctgggtatggtggcacgcgtctgtagtcccagctacttgggaggctgaggcaggagaattgcttgaatctgggaggcggaggttgcagtgagccaacatctcaccactgcactccagcctggcaacagagcgagactccgtctcaaaaaaacaaaacaaaaaacagagctccagccaggcctgcacatcctctttggttgagtaatttcaaactagaagcatgctccagtgtctcccttccatctcctcctctagagagagctgcttttctcttgtgctgctctaaatgaaaacagaaagtgaggggtgatgctcccagcagtcatcctgttaggtacagatggcggtggcatctcctcaactttctttgaagtctcttggccatccctgtagtggaagtggccatctgagaccccaccttttccacactgcttaggctgtaggtttcagaagtggtcccggctgtatcaaaatgtggctggtgcttcatggagcttcccacatagggctgtgcgtttggtagcgctgatattcaccaagtgacagacaagcaagataagctctctgcttatccgttgaccttcatgttagagcagtggacaagtttgcttcccaggggacatttggcaattttttgaagacattttttattgtcacaacttggagaggggagtaacggtgctactggcatctacagacagtccccaacttaagatgcttcaacttaggatctttcaactttacgatatagtgtgaaattgatctgcattcagtagaaaccatactttgagtacccatacaaccatcctgtttttcattttcagtacagtatgtaataaattacatgagatattcaatactttattataaaacaggctttgtgttagatgatgttgcccaactgtaggctaatgttagtgttctgagcacatttgatgtaacctgggctaagctgtgatgtttggtaggttaggtgtgttaaatgcatttttggcttatgatattttcaacctaatgggcttattgggatgtaactgcatcataagtcgaggggcatctgcagtgtgtagagatcagggatgctgctcaatatcctaccatacacagaatagccccccataacaaagaatgatctggccctaaatgtcaatagtgttgaggttgaaaagccttgtgttagcgtctaggagagaagctgtgggtagagtgaagaatggtcctgtatgggaagttgagagacttacagtccgagtaaccttactgaaatcatttcatgttgccaagtctcaatttctgcctttatagtagccccaggctacctctaaggtcctgtccaacttcagcatttccaccacctgccctctgggtagagtggtttaacaggaatccatgcagagaacaagagcagaggggacacaggggctgcaactccccactccagggacactatctcctgtttccaaggcctggagccagttgtgtgtcagaggctgaaatgctgattgaaaccaaaacttccattcaacatgacaaagggagaagggggatctaatttctaattaatcaaatacacgtttgaactgaaaattgggaattaccaacctgagagttaacagttactatttaaggctgatagggcgtatcttactctttgattcaaactgttgcatgttacaagtatttcgtgtgttgtacgagtaaaatggggaaaagaaggtttttgtgggtggaatgtcgggcaattttttaagcacattttgttgtgtatatgttttctttgcagccatttttccttaattcacattttaaagttacctgaagcccatcctcacacacagtggtcccccactaaccaccacgctccccgcctggtgtggcttactagctcgatgtctgaccagtccccaggtgtacgatgtaagtactgcacatcagggttggagtcctggtcaccatgccagggtagtgtcttacgtaggaagaagaaaccatcatactcatgcctccaaatccacagatttttgcttctctaataagctgattagaaatggccatcttccatatgtttatagatttcgcatagtaacagagaaagcttttaccagggtaatgggattcccccacatcggccgctgtggtgtagtagaagaacactggatttggaatcagagccactggattggaatgcaacccctgacaggccatagatgtgctctgcatctcagttctttctctctctctttttttttttttttttttttttttttttttttttttttttgagacggagtctcactctgtcgcccaggctggagtgcagtggtacaatctcggctcactgcaacctatgcctcccgggttcaagcagttctctgcctcagcctcccaagtagctgggattacaggcgcctgccaccacaccgggctaatttttgtatttttagtagagacagggtttcaccatgttggccaggctggtcttgaactcctgacctcgtgatccacccacctcggcctcccaaagtactgggattacaggcgtgagccaccatgcccggcctgcatctcagttttctaatctataaaatgggcctagtagtacaggctggctgggagcattaaatgatgaaatacatgaagatacactgaaccacaaagcatgcaaggattccttttctaaatagtttatttatgttgatatggttaggtcctttctttccattttcagattatagaaatagactcagcacagtatgaaaagaacatgtacactggtggacgtcttagatttagggctgactcctgcactcctggtgtgggttgcagggtacagggcagagaggtagagagagcaaggtagctacccacgtggaaggagtagaggagaggtcagaggccttccttcatccctcttcggccatcctaatcatcttgtcactaacacagtcattatgccctagaagaaaagaatttctaaaatttgcgtacagctctagagttcacaaaggctaagttcattcgttgggtcataccatgaatcagtgagtactgcagcattacagagaaggaaagtgcatctcagagaggatgtgagttggccccgggcccacagttagtaattagctgggaccctcatgcaggtcttcacattcttagcaaataacctgcagtttacttgattggtgatgagaaggcagaacacaaagcctagatctgaaagagaacggccctaaacaggtaagttctaacgaggggtagcagggttaggaaaggcagtgcacattcatgtggtatagaggggaaagggatgtggacaccatagctaggtgggggcgctggggcggaagagaagggcagccacatcagagcagccgagattggaggatgcagctccttaaatggcacgctcttccttcaagaacagggatgacaactgccaagtcaccatgtgtcctaaacccgctgctgcagagagctctgtgtgtctgtcatccctaggccctcggacctctccttggccccctcagaggaaggtgaccattgaaaagtcctggtaggcagcgacagaactttacactgggaaactcagctgggctactgggtttcacccccttcacagcaggttctgcctggtaaaaatgtagttctgccacagccgttgcttggaaatttcaccaaatgtggcagtagcgttcatgtgtctttctcttaaagatagttgaacttccaacacccacggctcctccccatataaaaatgaaattcctgtgccacctgtgataaactggttttaaatgacaaaaaaatatgtaggatggtgagaacaccatttctgtagaactgctcccagtttgtaaagtgatgtctaatgcttgcggtaagttttaaatgtaatatctatcagcctaaataataatgctagttacctgttaggttagaaggacacaaaccaatagattaaaaacttagttttgtaatttctcatcctgctactagcttacttaagaaaagctgtcttgtgctgaatgctgaatggtttgctcagtttggcccgctgtctaaagtggtagtaggggccctttacatacatcatcggagacaaagggtgctgacggcatttccacttctcccactaatgaagccccaactgtgattacactttctgatcttaagtttcactgggtttatatatataaatttgtcttctaactctagtctcttctaaacactttgtaaaactttccatcttaattgggttttaataaggatcacttttcatgtctatgtaatagtaaaacaacaaatccactattaaaactttataaaaaccttatctaatctgaagcttactaaccagtcccttgctcatagattaggaatatctggactagtttgaactcagcataaactcagtaagcttacaattgcatcaatttcaagtgcttctcccagcagttcaagggaccactccaagtttgcttctgggggtcatgtttcagctgtgactccccacagccaacctaagactgagtgacttgggcttctagtgagaatcaccctcggtcctgctgctgctgctgctttgagccggggtcctgcctagggtctcagccagctccagacatggtggggcctgctgctgagacagtgggagcaaagggtctcttcaaaattatcagtggaggaacccaaaactgacagaggtgaaggggctcactgcaaagtttagtgcctggtgagggtctcagactgggcagttctcgtagattttgacacctgttgcatggttcttacccaccatctaaaaggtgttttctactttgccaagtttatttggagatttctaagatgttcatcagtcattatttccactaacgttaaaccacttaggtgtggtatccagcttcctaacaatgttctttcacttttgaaaatgacttctggttatttaaaatgcacacatccccacacactgttgtttgcaggtgttttcactgcattttcatagcagacttaattgcacagctagttacatgattatatagaccttcagcgtaacaaaacaaacttgtgttgatcctatcatctagaattcaagggagcaggttagttttatcatctgcatgtaacattattagactttgatgtcagaatcactctccatgggttgtttgttttttgagacagtctcgctctcttgcccaggctgcagtgcaatggtatcatcttgacccactgcaacctctgcctcccgggttcaagcgattctcgtgcctcagcctcccgagtagctgggattacagctgcgtgccactatgcctggctaatttttgtattttttgtagagacatggtttcaccatgttgagcaggctggtctcgaattcctgacctcaagtgatccgctcgcctcggcttcccaaagtactgggattacagatgtgagccaccatgcctggcctctccatgggtttttttttgttttcttttgttttgttttgttttttgagacagagtcttgctctgtcacccaggtgggagtgcagtggtgcaatcttggcttgctgcaacctctgcctccccaattcaagcaattctcctgcctcagcctcctgagtagctgggattacaggtgcccaccaccaccacccggctaatttttgtatttttaatagagatggggtttcaccacgttggccaggctggtctcgaacccctgacctcgtgatccaccctccttggcctcccaaagtgctgggattacaggcgtgagccaccgcacccagcctccgtgggttttactatggccttgtttctgaatgacctttccttgagtactatgtctgggcttgggagtttcagaaatgcaatgggttgacatccagtcttgttttctcctgtcagtgaatttaggccctgcttccctctgcaaagagtgaaagcggaccacatcacagttcatgcccagggtttcctctgtggtgctgtggtgggctttccttcatttgcggaattaccctcacctgcagttatcctgtgtttgcctctgtccttccatggctccaaaccttgaagcagtaaaatatgtgccaggaccatttccctgaaaactgggagccaagagccctggcagagagattttgacagagatgaacaaaatcattatgtagcacgtgtatgaatgggagaattgggatgtgccgagacagggaaggtgaactccccaggagttggaaattcggatgggagacataagctaccggctgggtgtggtgactcacgcctgtaatgccagcactttgggaggctgaggtgggaggatcacctgaggtcaggagtttgagactagcctgaccaacgtggtgaaattccatctctactaaaaatacaaaaattagctgggcatgatggtgggcacctgtaatcacagctactcaggaggctgaggcaggagaattgcttgaacctgggaggtggaggttgcagagagccaagattgcaccattgcactccagcctgggtggcaagagtgaaactccatctcaaaaaataaaaagaaaaagaaagaaggctactgtaaagcagattgagtttcgggactttctaaacactggtaaagaggaggaaatttgggagtttaaatcaagttttagaactgtgctctgagcatctgcctgaatataggacttttatctcattgggcatttgcaccctgcttcattccagtgaggatttgaagcagcaagtgagaggagttgcgtgcttgcctgtcaaaaatgctgaagcattagttaagtggagtcacagtgtagactgtgtgtagggaagttgacaacactgagaatgcagaaaacaagtatgtgattgttgccagtgagtgcacagaaataagtctgggagaggaaacgcaacccatgagtcttccctagctggtgcatttacctggcattcacttagcacctactgtgaggtaagcaccattgaggaaggtgccaaggtgtggagaaggaggtcactgccctttggcgtttgtcatctagatggggctgatctcggggaatctgcccatggccttgggcagtgtgactgcgcgggggccctgagggggtcagagaggccagttcggcgccctggaggctctgtctcataagaggatgcaggacttcagatgagctttgaagggtcggtgggaaacaggagagaaaaaatcagtttacccagcgtatttgacactgtgtttgcccttctagaaggcagtgcacagtactcaataggcctcagtgcagcgcgggagctgggttgtggccctccccttgttttgttggttaaatctattggaggaagaaggtcctgtctgacctcgtgccgtctccgacactctcgctaccatctgatagttcaagtggttgcaactttgctctccctcgatcatttgattcatccacctgaggatgtggcgggtgggcttcctatcagggttttcctgtggggagatgacaggggaaacagggaggaaatcctgattatggcttgtcctcttccctgaattgctgtctatgacaaagagtagttccaatgtaaacaagacgggttggagacggtttgtatagggcaggagacccacccggaatgcctacccagagaagacagtacctgaaacctatttgcaacgtttgcccaattaccctactctggccttgctttgtgtgttgattgggaagctggaaatccaggctggtctccctttcttccctttttcactaaccccaagctgtcagacattgaaattagaaactgttttctagtattctaagtcctagtcctggcaaccgtgcccggccctctacagtttacatccagttaccacgctagaggctcaaggcaggcaagtttcatagtccccagttttcagatgaggagttgggattgggattggggttggtgccaaacctggaagatatcagtctctcatttttgttgttgttgttggttgcacttttcagaaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaaaggcaaatagtgttatactcttattttttgattaatctgaggaaaggaggtatttagaaactgatgatggtatcactgcaaaaagcattcaactttttttttttgttgagatggtgtttcactctgtcacccaggctggagtgcagtggcgtggtcttggctcactgcaacctctgcctcacgggttcaagtgattctcctgcctcagcctcctgattagctgggattacaggtgcccaccaccatgcccagctaattttttgtatttttggtagagatggggtttcaccatgttgcccaggctggtgtcaaactcctgacctcgtgatccacctcccttggcctcccaaagtgctgggattacaggtgtgagccactgcacctggccagcattcaacttttgagggctaccatatgagctgacagcctagggaaataatcactaggactgaagtatctactctgggtttagaaataacaccaaattttgtaggatgctattatctgggaaagggaaggcagcaagaaacctacaaggcaccaggctagaattcagagggaaagaaatctcaatgcaaaaaaattactgcaaagaaatacaagatagtagtctcaagactaggtagaattccaaactttgagccgacgaatgcatgagatttcagtggccacctgaggaatcagagggcaaacaatggaacattaagtattttcagcccactagaaagctctgtcttctataagcttaagagtccgagtgtctttacaccactgagtgccatgcagagaagggtcattttccttgtatctggggaggctgctgcaccagcttaacatgtgggtgtgatttgaaagttaggttttcagtttggattctttctggatgagctgttctgtctgcccacacctgtagtgctgaaatacagaaagacctctcgggaaa

SEQ ID NO: 3370 - DNA, 43722 bp, human
gccttaccccttactggaggctgcaggaccctctacacacagacagctgtccagcacggaaggtgggctgaggcccagggtgaacatgccagctaatgggacatcaccccagagattccctgccctgattccaggagaacctggcagatcttttgaggtaaggaggaggatcctatttttttctatatgttctttatttttttatttatttttagttaaatttatattttgagataattgtagattcaaatgcaatgtaccatttacctagtttttgtccccagtagtaacatctcgtaatacccaggatattgacatgcagagcatttccatccccacaaggatcccccatgttgtcattaaatagacacaaccacttcacttcctccatcactcccctcttaaccctggggcaccaccaatctgttctccaatactataattttttcatttcaagaatgttgtggctggacgtggtggctcacgcctgtcacctgtaatcccagcactttgggaggccgaggcgggtggatcacttgcggccaggagtttgagaccagcctggccaacatagtgaaaccctgtttgtactaaaaatacaaaaattaaccaggtgttgtggcacgcacctgtactcccagctactcgggaggttgagaccggaaaatcgcttgaacctggaggcggaggttgcagtaagccaagatcgtgccactgcactctgcctgggtgacagagtgagaccctgtctcaaaaaaaaaaaaaagttttatttgccgggcatggcagctcatgcctgtaatcccagctcttagggaggcagaagcaggaggatagtttgagcctaggagtttgagacctgcctgggcaatatagtgagaccctgttctccacaaaaaggaaaaaaaggacaaaaaagagagactgttatattaatcagattgtacagtatgtaccttttgggactggctttcgtcattcagcaaaattctgtggagatatcaatagctaacagtatatcaatagttcattcattttttttgagacagagtcttgccctgtcacccaggctggactgcaatggcgtgatcttggctcactgcaacctctgcttcccgggttcaagctattctcctgcctcagcctcccgagtagctggtattacaagtgcgtgccaccacacctggctaattttttgtatctttagtagagacggggtttcaccatgttggccaggctggtcttgaactcctgacctcgtgatccacctgcctcagcctcccaaagtgctgggattacaggcgtaagccaccgtgccctgcccattccttttattgctgatacttttccatcgcatggatgtaccaaacagtataaccattcactggttgaaagacatcttggttgtttctagttgttggatattatgaataaagatcctataatagtttgtgtaaggtttttgtaggggtgtgatactgtgaaatatataattggtctttcctggcaaacaactcctaatatcctcggaatctctaaagtactaaagtgtctttttgtatgctaatgagttgactgatgcctggcagtccctaggcagcttccgaatggggctggtcaccagaaagactaaggtaggtttagagggttgggaccctccaaccacctgggaggggagagggtgctgagagtcaagtcgatccacaagggcaaatgatttaatcaatcatgcctacataatgaagcccccctaaagccccaaaaggataaagtctggagagcttctgggtagccgaacacatgggggttcctggagggtggtgcacccagagagcgcatgaagactccaggccccttcccacatgccttgccctatgtatctctttatttggctgtgatttatttgtattctttttttttttttttttgagatggagtttcgctcttgttgcacaggctggagtgcaatggcgtgatcttggctcactgcaaactccacctcctggattcaagtgattctcctgcctcagcctcccaagtagctgggatcacaggcatatgccaccacgcccagctaattttgtatttttagtagagatgaggtttctccatgttggtcaggctggtctcaaactcccgacctcaggtgatccacctgccttggcctccaaaagtgctgggattactggtgtgagccaccatgcccggcctgaatttgtattctttaaaatatcctttattggtgggagaggccggagaattgcttgagttcaggaattcaagaccagcctgggcaacaaagtgagacctcattactacaaaaaataaagctcaggtggggcacggtggctcatgcctgtaattccagcactttgggaggccgaggtgggaggatcgcttgaggtcaggagttcaagactagcctgaccaacatgataaaacctcatctctactaaaaatacaaaatttagctgggtgtggtggcgggcacctgtaatccagctactcgggaggctgaggtaggagaatcacttgaacctgtgaggcggaggttgcagtgagccgaggtcgcaccactgcactctagcctgggcaaaagagcgagactctgtcttaaaaaaaaatcctttataataaatcagtaaacatagtcagttttgtgtttcctgttgagggtgagcggccactgtctgggccggtggctcacaggtaaaagaatttaccacgacagttgtaggtaaagaaaggcagatttattagagaaaggaggaaaatacattgcaagagagcaacaggtagaatcagcaaaagaggaactgacttcgaggaaatgaaggcttgctggagattttataggatggttcttgggctgtttgataacgccaaggtagcagggagctaacttgcattcttctgtcagccaaggtgtttgatgatgaattggagtgtttgatgataagcaggaagtttgtgagttatgtacattatttgctcaagaagactatatgtcctgggccataaagaaagacagacctataacttaaacttatctgcatcttctttttgtttatatgtcctggagcaactccttttccctaattaggactccacatttccctgagttttttttttttttttttaaatgcagggtctctctgtcgcccaggctggagtgcagtgacagcttgcttactgcagcctcagcctcccgggttcaagtgatccttccaagtagctaggaccacaggtgtgtgccaccacgcccggctaattaaaaaaaatttttttttttttaacagatgaggtgtcactttgtttcccaggctggtcttgaactcctggcctcaatcaattctctctccttagcctcccaaagtgctggcattacaggcatgagccactactcccagcctttccttgagttctatgagccactctagcaaattaattgaaccctaggaggggattgtgggaagcttgacttgtagctggtcagtacgaagctctggagtctgaagtgggggtagtcttcagaactgagccctcaacctgtgggacctgatgctatatcctggcagatagtgtcagaatggaattgaattggaggacacccagctgttgtctactgcagaattgacctcttgcttgatgtgtgaggaaaatccctcactcatctgttgtcacagcatgttatgagagtctagtaggagaaactgtgtttgtatttctactcctacacagtggggtaaatgcatgtgagaacaattgtgggattgtatgccaagtgcatatagaacagaattaatagacaatctttttttttttttttttttgagacagagtctcactctatcacccaggctggagtgcagtgatgtgatcttggctcactgcaacctctgcctccccggcccaagcgattctcatgccttagcctcctgagtagctgggattacaggcacccaacaccataccctgctaattttttgtatttttagtacagacagcgtttcaccatgttggccagactggtctccaactcctgacctcaggtgatccacccgccttggcctcccaaaatgctgggattacaggtgtgagccaccacgcccagcaatcttttttttttttttttttttttgtgagatggagtctcgatctgtcacccaggctggagtgcagtgatgcaatctcggctcactgccacctctgcctcccagcttcaagctattctcctgcctcagcctcccaagtagctgggattacaggcacccgccaccatgcctggctaatttttttgtatttttagtagacatggggtttcaccatgttggccaggttggtctcaagctcctgacctcagcctcccaaagttctgggattacaggcgtgagccctgagcccggctgacaatcttttttttttttttttttttttttttttttttttttcagacagagtcttgctctgtcacccaggctggagtgcagtggcacgatcttggctcactgcaacctctgcctcccgggttcaagtaattctcctgcctcagcctcccgagtagctgggattacaggtgtgcaccaccatgcctggctaatttttgtatttttagtagagacagggtttcaccatgttggccaggctggccttgaactcctgaccttgtgatccacccacctcggcctcccaaagtgctgggattataggcatgagccatggtgcctggctgataatcatttttaatacagttttagaggtacagaaaagttaagatagtacctataattccatatgctgtcacctcctcaaccccccccacaactggtgcagttttccctattattcacatcttgcattagtgtggtacatttgtaaaaattaatgaactgatagtgatatattactattaattttagcctacagtttatagtaaggctcactgctttgtgttgtacataggggttttggcaaatagatcatgacatatatccaccagtgcagcttcatacagtttcattccgtttcacctgtgcttcagcgattcatcctgcctttccctctgcccgaacctctatcaaccactcattttttactgtctttgtagttttgccttttttttttttttgacactgtgcctcactctgttgcccaggcaggagtgccatggtgtgatcactgctcactgcagcctctacctcccaggctcaggtgatcctcccatctcagcctcctgggtagttaggaccacaggcacatgccaccatgtctggctaattttcagtattttttatagagacacggttttaccatgttgcccagtgtggtcttgaactcttgggctcaagcaatttgcccacctcagcctcccaaagtgctgggatttacagatgtgagctattatgccaggtctagttttgccttttctaaaatgtcatgtagttggaatcatgcagtatgtagtcttttcaaactggcttctttcacttagcaatttgtatttaaggttcctccatgtttttttgtggtttgatagttccatgaattggaagtaccacagtttgcttattccttcacctaccgaagggcactttcattgtttgtaggttttagcaatgatgaaaaaagctactatgaacattcatgtgcggatttttgtgtgaacatgttttgaactcaattggctaaataactaggagcataattgctatgtcatataagctttataaactttataagaaactgcccaggcagggcgtaatggctcacacctataatcccagcactttgggaggctgaggcaggtggatcacctgaagtcaggagttcgagaccagcctggccaacatggtgaaatcccgtctctactataaatacaaaaaattagctgggtgtggtggcaggtatctgtaatcccagctacttgagaggctgaggcaggagaatggcttgaacctgagaggcagaggttgaagtgagccacgatcgcgtcattgtactccagcttgggcaacaagagtgaaactccgtctcaaaaaaaaacagagaaacttcccaactgtcttcccaagtttttcaccattttgcattcccaccagcaatgaatgagtattactgttactcctcatcttcaccaatgaaaccaccattgcaaaattgtaactgagacagtgaaagagatctaatctgatcaaccccatctttcttcaaacctccgagctgtccttgttcattcccgagcataggctgaactaacttagggaggaacttagtttgtagtttaaaacaaagatgttaacaggcttttcccaaggcaaatcccctgcttgcctggggactagattgcctttgtaggaataacaagttagccaccagatagaaattatggtttaggagtcatgcagccggagactacaagattctgaccctctctaaactgctcctaagatcagtgcttgagatattttgcagaccctggacctaatggatcagctggcaacacccagatcgataaattggctcatctgatcttgtggcccccacccaggaactgactcagcacaggaagacagcttccattccctacggattcatctttgacctgaccaatcagcactcccggcttacactggctctcccctacccctgccccccaccccaccaaattatcctttaaaaactctgatccccaaatgctcggggagactgatttgagtattaatacaactctgggtctttgtgaattactctgtgtgaattactctttctctattgcagtttctctgtcttaataaatctgctctgtctgggtaacaggcaaggtgaagccattgggcagttacaccagcatttggtattgtcagctttttaattaattaattaattattttgagacagtgcagtggtatgatcacagctcgctggagcctcaacctccccaggttcaggtgattctcccacctcaacctcccaagagtagctgggactacaagcatgtgccaccatgcctggctaatttttgtatttttagtagaaatggggtttcaccatgttgcccaggctggtcttgaactcctggcctcaaatgatcctcccgcctcagcctcccaaagtgctgggattacaggtgtgagccaccatgcccagcctttttttttttttttttaaaaaaaaccacattctaataggtgtgtgatcctatctccttgttttaatttgcaattctctagtgacatgatgttgaggacctttttatatgcttatttaccatctgaatgtctttgatgaggtcatcttttcagatcttttgcccactttttaattgagtagtttgttttcttattgttgagtttaatagttctttgtacgttttggatactgtaacctcccaatgggttccccttgcccgctgcctagacagagctgatattaagacaggggaactgcactagagaaagaataattcacgcagagccagctgtacgggagactggaatttttattattactcaaatcagtctccctgaaaagttggggatcggagtttttaacgataatttggtgggtaggggccagtgagttagaagtgctgattggtcaggtcatggatcaaatcataggagttgaagctgtcctcttgtgctgagtcagtgcctgggtgggggccacaagaccagatcgagccagtttacggatctgggtggtcccaactgatcaattaagtgcagagtctgcaaaatatctcaagcactaatcttaggttttacaattgtgatgttattcccaggaacaatttggctagagtcagaattttgtagtctctagttgcatgactcctaaatcattacttctaatcttgtggctaatttcttagtcctacaaaggcagtctaatccccaggcaggaagggggtttgttttgggaaagggctgttatcctctttgtttcaacgttaaactataagccaagttcctctcacgctgggcgcggtggctcatgcctgtaatcccagcacttaggccgacgcaggcagatcacctgaggtcagaagtttgagaccagcctggccaacatggtgaaacctcgtctctacaaaattataaaaattagctgggcgtggtggcctgcacctgtaatctcagctactcgggaggctgaggcaggagaatcgcttgaacccaggaagcggaggtagcagtgagccgagatcgtgccactgcactccagcctgggcgacggtgccagactgtctcaaaaaaaaaactaagttcctctcaaagttagtttggtctgtgcccaggaatgaacaagggtagtttggaggttagaagcaagacggagttggtttaggttggatctctttcactgtaataattttctcattataattttacaacggtagtttcaatacaagtcctttatgagataagtgttttgcaaatattttctcccagtctgtggcttgtctattctgtcatcagcgtctttcacagaagagaagtttctaattttaataatgcacaacgtactgttttttttttctttcacaggtcatacttttggtgttgtattcatatacatatatatttttatagagatggggtctcactaggttgcccaggctggtcttgaacgcctgggctcaagcgatccacccacctcagcctcctaaagtgctgtgattacaggcatgagccactgcacttggctggtgttgtatttaaaaactcatcaccaaacccaaggttacttggattttcttctttgttatcttatagaaattttatagtttttcattttacatagagatctataatccattttgagttaatttttttttttttttttgagacagggtctgcactccagcctttgtcacccaggctggagtgcggtggtgcgatctcggctcactgcaacctctgcctcctgggttcaagcaattctgcctcagcccctggagcagatgggactacaggtgcacaccaccacaaccgactaatttttgtatttttagtagagatggggtttcaccatgttggccaggctggtatcgaactcttgacctcaagtgatgcactgccttggcctcccagttttgagttaatttttgtgaaacatataaggactgtgtctagatgctttttttttttttttttttgcatatggatgtccagttgttccagcaccatttgttgaaaagacttatttcttcaccgaatttcttttgctcctttgtcaatgatcagttggctgtttttgtgtgtatatatatttctaggttctctattctattccattgatctatttgcctattctttcaccaatacctctgtcttgattagtctagttttatagtaagtcatgaagttgggtggtctcagtcctctgactttgttcttgtttagtactatgttgactactttggatttttgcctttccatataaactttagaatcagtttgttgatagccacaaaataatttggtgggaatttgattgggattatgttgaatctcctgatcaaggtggggacaattgacatgttaacagtattgagtcttccctttagcagcagagaatccatacgggtctgcagcaacctcaattcttgcctcctcagaaaaaagaatttgaggggcataagacagagtgagagaccagggcaagttttagagcagtagtgaaagtttattaaaaagctttagagcaaggatgaaaggaagcaaactacacttggaagagggccaagcaggcgacttcagagatcaaatgtgcggtttgactttgacttggggttttatgcttcctgggtctatattacccctcctttgattcttaccttggggtgggctgtccgcatgtgctgtggcttgtcagcgcttgagaaggggccgcatgcgcattgtggttactgaagttctacgcatgctcacttgaggagtttttcccttaccagcggagtgttcctaaaggaaggttatataccagttaaactcggccattttgcatcgtagtgcacatgtcttgagcccactggcccaactcctgagatcttattgggaagctgctgatcaccagtttcaggttttttggtatctgttgagagactgcctttccctggcgccagctgcaaccaattattatttttatttattattattatttttcttttttattattatttttcttttttttttaggaggaacaggagaagcaggaggaggaggatgagcaggagagaaaggaggaggagaaagaggaggaagaggagcaggaggaggagaaagagaaggaggagcaggaggaggagaaagagaaggaggagcaggaggaggagaaagagaaggaggaggaacaggaggagcaggagaaagaaaaggaggagcaggaggaggaggagaaagagaaggaggaggaggaggaagaggagcaggaggaggaggagcaggaggaggagaaagagaaggaggaagagcaggaggaggaggagcaggaggaggaggagaaagagaaggaggaagagcagaaggagaaagagcaggaggaggaggagcaggaggaggaggagaaagagaaggaggaagagcagaaggagaaagagcaggaggaggagaagcagcaggaggaggagcagcaggaggaagaggagcaggaggaggagcagggagcaattattattttagagagacagttttaacaactgcctgaccatcacctcctggtggggtttgagggggggtgctctcctgctctgctcatgtctaactacctaactacctaattactctaacatttctgtcaataaacatgcaatatctctctgtttacttatatattctgatatatttcatgtcaaattttgtttgattttcctcatgtatgtcttctacatattttgttaggtttatgtatattttatctttttggtgctaacgtaaatggtattatgtttttaattttaaatatcaattgttcatttcgggtatataggaaaacaattgacttttattaagcctgtatcctgtgactttactataatcacttaatagtgccagaaaatcctttactgaaatggattgtgagagtagctaaatgataggggtagtatgtttgattttgaatgctgtagagtggaagagcatgtctgggttgatgcaggacccacagctcatagtgaccaatcacagatggctgtacttgagccagacacacaaaaacacaagaagttattcatgagggaagacctagcatgccagacttgctcaaagccactgtaaagtgtgtttaccctgtcagcggaaagagtcaaattctgtaaaatatttgaagagacttattccaaaccagcactcaggagatactgagaacaggtgcccaaggtatgtgttagatgtccactgattcggttcggaaaggcgggacaacttgaagtgggggcttccaggtaacaggtagataagagacaaaaggttgcattctcttgggtctttgatcagcttttcactgaatacataatttacatgtgagaggggatagaatagtctgcctaatgaaacaacagggcagaggaagcaatcagatacccatttgtctcaggtgagcagagggaggacattgagttctgtctgtcctttgtcatcctgcacctgtgaagataagctatcaatttacgttgccagggtgaaattcaacagaactttttttttttttttttttttttttgagacgcagtctcgctctgttgcccaggctggagtgcagtggcgtgatctcagctcactgcaacctctgcctcccgggttcaagcgattctcctgcctcagcctgcgagtagctgggattacaggcttgtctcggactcctgacctcgtgatccgcccacctcggcctcccaaagtgctgggattacaggcatgagccaccgcacccagcccagaacatcttaaggtaaaggtcttgaggcccacaaggtcttttcttgtgggcaaattgcgagggaggcatgtagccttttttttttttttaatctttgtagctatcttatttgggaataaaatgtgaagcaggtttgcctaacaccctttggcttaatgattttggagtcctgagatttattttccttcacaaccctaagtataggactgtgtaacatatgccaagaggagcacccctgatgaagcagctgataggcttcatatgcaggccatgtgggactggctttatggtgcctatgatattcacccactgaatatgcccattacccaggccatattcagctatggttaaggggtctttttgcataggcaccccatgtaaacttacagctgcaaaatacagcaatagacccaaaagcctcattgaatttgctgcctcagcttcccttcagggatcccacagctgctaatgaaaacattaagttaacgtgaaaatggggagaagcctagggaagggtcaagtctaccagcaaagtggaaatctctcagtggctattaagaaatgggatggccgggcgcagtggcttatgcctgtaatcccagcactttgggaggccgaggtgggcggatcacaaggtcaggagtttgagaccagcctggccaatatggtgaaaccccatctctactaaaaaatacaaaaaaattagccaggcgtggtggcgggcacctgtagtcccagctgcttgggaggctgaggcaggagaattgcttgaacccgggagtcacaggttgcagtgagctgagatcgcaccactgcactccagcctgggtgacagagagggactcagtctcaaaaaaaaaaaaaaaaaaaaaaaaaaagaaatgggatggctgggctttgtttggtggctcacacctgtaattccagcactttgggaggctgagacaggtggatcgtttgagcccaggaattcaaaaccagcctgggcaacatagcgaaatcccatctctacaaaaaaaaaataataaataaaaaaaattagctgagcatggtggtgcacgcctgtaattccagctgcttgtgaagctgaggtgggaggatcacttgagctggggaggtcaagcctgcagtaagccatgatcgcaccactgcactctgtctcagaaaaaaaaaaaaaaaaaaaaaaagaccaagggcaaaggttctttggctccaccccgggatggggacccaaagctttgtgcacatgaaatgggtggtgaagagaagtttctgggtaaaatgggaggaaaagagaactttctgggacccctttatatggaagcctcatacacggaggtaccaaaatccattagtgaagctgtaacatgggctacaactagactgggagaatatagaaatgtaacagttgataggattaaggtgtacatttgggtgaaaattggaatgtgtttaaacaggctttgtggctgggtgcggttgctcacccctgtaatcccaccactttgggaggccgaggcgggtggatcacttgaggtcaggagtttgagaccagcctggctaacatggtgaaaccctgtctctactgaaaattaaaaaaaaaaaaaattagctgggtgtggtgacatgtgcctgtactcccagcttctcaggaggctgcagtgagccgagatcgcgccactgcactccagtctaggtgacagagcgagacaaagtctcaaataaataaataagttttttttaaaaaataaaaataaacaggttttagctgaatgttttatgggaatggatattatgactgacagggaacacttcccttaactagtattgtgacactcaaacctgttgatgaaatcccaatggaggaatgtaagggttgatgggattaaggtggaagtttggaaaatttgtagatttgaacaggctttatttgaaatggttgcatctcttttacctcaatgtattatggagattgaaattgtatctgactgtggaatgtttcccctctctagtattgtaaattcacccttcaaccagtattacttgaacatgctaaacgggaaccagtaagattgccgaagcccacgaagtatacaatagaacctggggtgccgcacagacagattacctgtacaatagccctttgtggagcagagaccggcgcttatggcaaaagcctaagagcgcctcctagtggtaacctgggactttggactagagaatttccagttgagcttggattagacattaattgaaagtgcccttatgattgaaggacataaaataattttgaaacctaaaatatccatgatgtcttgggtgatggtgtaacgctccaatagggagtgcagtgcccagagtagttccataattacatggaaatggttcgtacaagaatatgctgccaggggagtgcggaattagcggttttcacaaccaggtagactcctttccgccgggactgatggaggaggagctggtcggttctgtcatcgactggacaatgctccagctctcaactgaccaacaaaaagatgcttggtttgtggatggcagttccaaggcgaatggactgcatcgtgtttggatgtcccaatggcgtccattatagcaaaaggatccaatttaggattatgtttagcatttacgtgtcatcactttagtgttattcagttgagaaggttccttctttgcctctcataactctttgaagatttaattaaataatagtatttaagtatttacaaatttatattcttctcatcatataaattggaataatgattactgaagcagatctgaatagtcatacaagtaagtatatagaatatatattagttaccccagagcatgaagagagaaattcccatgagctaaatattcacatgatggattttacggtgttactctaagtccagtccacctagcatttccagttgagcacacccttcctaggtgaaatgatagaaagaataacaaactcttgagtgctagctctgtatcagtgctgccctaagcgattccgtgtgtgtgtgtgtgtgtgtgtgtgtgtgtgtgtgtgtttgagacagagtcttgctcatgttgcctaggctggactgcagtggcacgatcttggctcactgcaacctctgcctcccgggttcaagccgttctcctgcttcagcctcctgagtagctgggattacaggtgcgtgccactacgcccagctaatttttgtatttttggtagagacaggatttcaccatgttggccaggctggtctcaaactcctgacctcaggtgatccacctgcctcggcctcccaaagtgctgggattacaggtgtgagccactgcacccggccatgattccacgtatgaattcacccaaatttcacagatgacaagactgaggctcagaggaaggtagtaacttagccagagtaatagcacgagtgtgagtcagagccaagatttgaacccaggcagcgtggctcccaccaccatgttcttgcttgttctcttctgtgtccaggagattccttcctacctgaccttgttctcgacgctctctggttacttctgcatagccacagtctaaagcagttatacaaccatcctaggtgagctatgcatttttaaaaattaaactttgattttgagatcagtatcgattcccatgcaattataggaataatacagagagatcgtatgtgcgctttatccagtttcttccaatggtaacaccttccagaacaatagcacaatatcacaaccaggatgtggccattgacacaaccccaggatgtctcctgctgccctttcacaaccacacctgctacccttgttcctgccatctatcccctcgaggttcctaaccccgacactaatctgttctctatctctagaatgttgtcatttcacgagtgttatataaatgaaagtatacagtatgtgactttttttgtttttttttgagatggagtcttgctctgtcgtcaggttggagtgcagtggtgcgatctcggcttgctgcaacctttgcctcccaggttcaagcaattctcctgcctcagcctcccaagtagctgggaccagaggcgtgcaccatcacacccggctaatttttgtatttttagtagagatggagtttcaccatgttggccgggctggtcttgaactctggacctcaagtgatctgcccatttcagcctcccaaagtgctgggattataggcatgagccacgccacccggctcccaatttgccctttatttatttgttatttatttgcttgttgcctttgtttcctgtgtattttaggatgcttctaagtataaataaatacgtattagaataaaaggaagaaaaaaaagaagaaaatatcaatacaagttttagaaagtaggcatgcctgtcagcaatcctactgagcctactgaacaagaaaactttgcagtcttttttttgtttttgttttttttgagatggagtctcactctgttgcccaggctggagtgcagtggtgtgatcttggctcactgaaacctctcttcaagcgatttcgtccatcagcgtcccaagtagctgggactacaggcgtgcaccaccatgccctgctaatttttttttttttttgagtcagagtttcgctcttgttgcccaggctggagtgcagtggcacgatctcagctcactgcaacctccgcctcccggattcaagtgattctcctgcctcagcctcccgagtagcctgggattacaggcatgcaccaccatgcccggctagttttgtatttttagtagagacggggtttctccatgttggtcaggctagtctcgaactcccgacctcaggtgatccacctgcctcagcctcccaaagtgttgggattacaggcatgagccaccatgcccagcctgatttttgtagttttagtagatggggtttcaccatgttggtcagggtggtcttgaactcctgagctcaagtgatccgcccatcccagcctcccaaagtgctgggattacaggcataagccaccatgcctggtcctgaagtcttgcttaatctgtatattctaggaagacacagcagagcaggagctgcaatcaagaattacaatgcctcagtcgggcgcggtggctcacacttgtaatcccagcactttgggaggctgaggtgttctcaggagttcgagaccagcctggccaatgtagtgaaacccccatctctactaaaaatacaaaaactagccaggcatggtggcacatacctgtaatcccagctacttggaaggctgaggcaggagaatcacctgaacacaggaggctgagattgtgccactgcactccagcctgggtgacagagcaagactctgtctcaaaaaaaaaaaaaaaaaaaaaaagaattacaatgcttctacggagaaatcaataattcatttatagtggagagttcctgatatttaaatttttttattactttattattattttcttagagaattacaatgcttctacagagaaatcagtaattcctttatagtggagagttcctgatacttaaatttttttattactttattattattattttcttagagacagggtcttgcttcatctcccaggctggagtgcagtggcacaatcatagctcattgcagcctcgaactactgcactcaagtgatcctcccacctaagcctcctgagtagcagtgactacaggtgcttgtcatcacgcccagctaatttttttgatttttagtagagatgaggtctatgttgccctggctggtcctgaactcctgagctcaagtcatcctcccgcctcagcctcccaaagtgctgggattccaggcctgagccactgtgcctggctatgtgtttttttgttttttttttttgagtcagagtcttccacctgagtctcccgaatagctgggaccacaggcgcacaccaacatgcctggctaattttttaatttttatttttgtagagacagagtctcattatgttgtccaggctagtctcgaactcctggcctcaagcactcctcctgcctcagcctcctgagttggtgggattacaggtgtgagccactgcatgcagcagttcctaatacttgagtgtcaagaaatcctctggggtgtgctcagagcagggggcctgaagaatgcttcttctgtttacaacacacccaataggaatctggggtcattgtgacggggggcacaaaacttgtgacctctctatgaacaaatgccccacatgtgaaaaaaagaaatcttttgttaaatcttcatacggatgatggaaacaatattttcttttcttttttttgagatggagtctccctcttttgtccagcctggagtgcagtggtgcgatctcagctcactgaaacctctacctcccaggttcaagcaattctcttgcctcagcctctcgagtagcaccaccacgcctggctaatttttgtatttttagtagagacagggttttaccatgttggctgggctggtctcgaactcctgacctcaagtgatccatccgcccttggcctcccaaagtgctgggagtacaggtgtgaaccaccacacccggccggaaacaatattttcaattacaaccttgtcataagtgatattacaggtcttctgtggctatttgtcatttgaaaagattttttcattaattttttttcttttttcttttttttgagacagagtcttgctctgtcgcccaggctggagtgcaatggcagatctcagttcactgtgacctctgactcctgggttctagcgattctcctgcctcagccttccaagtagctgggagccattaatttttttttttttttccaagacagagtcttgctctgctggtcaggctcaagtgcagtggcctgatcacagctcactgcagcctcaatctcccaagctcaagcagatcttcccacctcagcctctcgactagctgagactacaggcgcacgtcgccatgcctggctaattttttaatttcttgtagataggaggtctccctatgttccccagtctctctccttggtctcattcagtttttaagtaagattttaaaaactacaggatgaagggcgggcacagtggctcatgcctgtaatcccagcactttgggaggccgaggtgggtggatcacttgaggtcaggagtttgagaccagcctggccaacttggcaaaaccccgtctctactaaaaatacaaaaattatctgggtgtagtggcacatgcctgtagtaccagctacttgggaggttgaggtgagagtattgcttgagtccagaaggttggggctgcagtgacccaagatcatgccactgcattccagcctgggcaacagagcgagaccctgtctcaaagaaaaataaaaggaagcagtggttattgcatattgtactgtacttgtctcgctaccactgagtagaatttgcattccacgtattttcatctttaccatcctcttgaatcttcagtctatcttcccttcctgtttgatgtcttcatgcttttccagcactctttttctggctggttctatttttttctgagttggtagatggtgcacaatttgagttttctgatgattttattctcaaagaagcctgtgtgggaggagcattactaaataaggaagtgctagtcaatatccagatgactagaaatggataaagtattgttcccaacagggatccagtgtccccacgggatgagcataccttggatatagtcagtcttcctatctgtgcctcaaactgctgtgctgcttcttaaggagcttccaaagggaagctgatttgtgaagggagaaccatcaaaaagacagaattgaatgactgcagtagtgcttctttgtcttgtataagatttcctcttgggctgggcacagtggctcatgcctgcacaaaatgcccagcactttgggaggccgaggcgggcggatcacctgaggtcgggagttcgagaccagcctcaccaacatggagaaaccccgtctctactaaaaatacaaaattagctgggtgtggtggtgcatgcctgtaatcccagctactcgggaggctgaggcaggagaatcacttgaatctgggaggtggaggttgcagtgagcccagattgcgccattgcacgccagcctgggcaacaagagcaaaactccgtctcaaaagaaaaaacgttttcctcttgaattccatttctgcctgtttttagcagagcagcagctttggcagcttctctctctgtctctctgtctctgtctctctctctctctcatctggtctttgtgaaatgagcagcactctgcgtgattccatgcagttgtctgtttcatatgtctttcagctgccctatattctgcctttcctgtttctttgttcttacattctttttgtcaattgttcttgtttcttttgatatacagcatttctctttcagttttccttctcaatttccctcttgatctctttgttcttccacttaccttttcaagtattttggttagtcttagtctgttcactctgacagtgaggttcttggtaggtttttgatttgaccttcctctaagctccctttgaggcaatgacatgccctgatctgtttcctcttgtttaatatatatgactttgtgtcaggagaggtaggtggtgtatcacaaaactcaacatttctgcactgaaagttttccaaagtgttacaagtgttactgggttcaaatgagggatgaaacagtgactaaactttctgactggctcccatttgcaactcatgtttcagtttttagttactgcatcttttggtttactctcttatctgaaatacttggcaccagaagtgttttggattttttttcttattttggaacgtttgagttatattcactgattcgggatccctaatctgaaaatctgaatccaaaatgctttaatgagcatttcctttgagcatgatgttggtgcttgaaaggttttgtattttggagcatttcagattttggattttttttcccctctcctcttctggaaaaagacagagtcttgttctgtcttgcccaggctggagtgcagtggcacgatctcggctcactgcaacctccgcctcctgggttcaagcaattctcctgtctcagtctcctgagtagctggcactacaggcatgtgccaccacacccggctaattttgtatttttagtagagactgggtttcaccgtgttggccaggctggtcttgaactcctgacctcaggtgatccactcgccttggcctcccaaagtgctgggattacaggcatgagccactgcgcctggccaagattttggatttttggactgtggatactgaacctgtattgatttttttttttttttgagagggagtctcgctctgtcgcccaggctggaatgcagtggtgcaatctcagctcaccgcaagctccacttcccaggttcacgccattctcctgcctcagcctcctaagtagctgggactacaggcacccgccaccatgcccggctaattttttgtatttttagtagagacagggtttcaccgtgttagccaggatggtctcgatctcctgagttcgtgatccacctgcctgggcctcccaaagtgctgggattacaggcgtgagccaccgtgcccggccctgaacctgcattgctgttaatagcaacagaactgtttgaggatgcttctgtcactttgtcatcttcctaacctgcagccatctgtgtaggctgtttatcatcagctgccatgacactatgacaactgtgatgttactcttggccactgtgatggcaacctgaatggtttcctggaagtatagcatcattcccctctcctcttctggaaaaagacacttgtcattgaatttaggggctacccagttaatccagaatgatctcaactcagatccttaactacatctgcagagatcctttttccaaataacacccaggtaacattcaccgtgcctgggtgttaggatgtggatacatcttttgggggagtgcaccattcaacccactatagtttgttctctagcctccaaatttatgtccatcccacatgcaaaatacattcatcccattccaacatacccaaaagtcttaatgcattacggcatcagtttctgcctgtggatctgtgaaactggaaaacaagttatctgtttccaaaactacaatggtgggacaggcataggacagatattcccattccaaaaggcagaaattggaagtcataaagggttcactggtcccaatcaagtttgaaacccagtagggaaaatatcgttagattaaggcctgaaaaatatcccctgttgaggccgggcatggtggctcatgcctgtaattctggcactttgggaggccgaggcaggtggatctctgaggtcaggagttcgagaccagcctggccaacatggtgaaaccccgtctctattaaaaatacaaaaattagccaggcatggtggcgcacgcctgtaatcccagcttctcaggaggctgaggcaggagaatctcttgaacctgggaggcggaagttgcagtgagccgagatcctgccactgcactgcagcctgggggatagagtgagactgtctcaaaaaaaaaaaaaaatctcctgttgctctgctctcttggcctctgcctcgcccatgcctctgcacctgcggttctgcccttggagtcattcttcctttgtgttgcaggtagcacatgcttataaccagatagttcgatcagcccatttcctgcctataaagttttggaagtctgacagccttctgtcattttgtcttttctctgtttctttctgtttaagctggcagtgtttgtactggtataacattcccaaaagccttgtcactctcctgtatgtgttcgtattagagaagaaggccgtccacagagctttcttggataatcccatctctattcctgattctgctgaaatgggtcatcggatccttgagtatcacaaagagcatgctttcccaacagtgaattttctttcttttttttctttttgagacaaggtctcactctgtcatccaggctgctgtgcagtggcatgatcaccgttcactgcagccttaacctcctgggctccaacccagctgtcctcctgtctcagcctcccaaatagctgggactaccggattgagctaccatccccgccaccctcccccgcccttttttttttttttagacaaagtcttgctctgtcgcccaggctggagtgattaaaccattaaaccactgaccactggtgatcaagtcaaccttcagccactctcccctcccaggaggttgagtatggggctcaaagttccaaccccaatcaggcacttaactaattctgtttattttttgtagagacggggtctcactttgttgcccaggctggtctcgaactctttttttttttttgagatggggtcttgcactgttgcccaggctgaagggcagtggcacgatctcagctcactgcaagctctgcctcccaggttcacaccattctccgcctcagcctcccgagtagctgggactacaggcacccgccaccacgcccggctaatttttttgtatttttagtagagacagggtttcactgtgttagccaggatggtctcgatctcatgacctcgtgatctgcccacctcggcctcccaaagtgctgggattacaggcgtgagccaccgcgcctggcccctcgaactcttgagctcaagtgatcctcccaccttggcctcctacagtgctgggattataggcatgagccactgcacctggccaacagtgaattttctaattttagcatcttttacaatctggataggctgagaatctcccaaatcatcaagtactggttccttttggcttaacagtttcttactcaatgtatctcttatgtctcacattttcctgaaagctgtaagaaaaaaccaggccgccccttcaaatacgttgctcgaaaatctctcagctaaataaataccgaagtatttgtgtggaaagtacctctgggtatttccagaataaaattctgttaagttttctgccattatataacaaggatggtttttcatctagtttccaatatcatgttcctcatttccttctgagtcaaaactagaagcacctttaacattcatatttccaacattttgtgcgggatgatgtttgtattctgtaagatgatagaagctttcttagttgtgttacttcctccttctgagccctcctcagcagtgttttttttgttttgttttgttcttttttttggcaagatctcattctattgctcaggctggatggagtacagtggtgtgatctcagctcactgcagccttgacttcccaggctcaagtgatcctcccacctcagcctcccacgtagctgggtctacaggagcacaccaccatgtccagctaattttttgtatttttgttggtagagatggggtctcaccatgttgcccaggctggtcttgaactcctgggctcaacctatccgtccaccttggcctcccaaagtgctggggttacaggtgtggaggcatcaccatgttgcccaggcattgctcacactccttggctcaggagatcctcctgcctcagcctctcaaagtgttgggaatataggcacgagccactgctcctggctagatttttttattcaagaaatgggcgtcttgctatgttgcccaggctggttttgaactcctgagctcaagctatccttctgccttggcgtcttgaatagctggggctacaggtgtatgtcaccatgcctggcttaattgtagatgttaatcacatctacaaaataccttcacagcaacacctagattagtgtttgattgaataactggggcatatatccagtccaactgacacatcaaattgattattgcaatccacccctcattatcttggcacctttacatatctctttaaatcatacttaatctctaaataaagataacaagctcatacttctgcgtaacatgatgcaattctcaagtatacaactaaaaacaccttcttttcctcagaagaggagacaaagtcagtgggtgatgctcacactttcccctgatgtcctgtaacttaaataaataaatattgtggtccaggagtggtggctcacgcctgtaatcccagcactttgggaggccgaggtgggagggtcacttgaggtcaggagtttgagactagcctgggcaacatggtgaaaacccatctctacaaaaaatgcaaaaattagccaggtgtggtggcgtgtgcctgtggtcccagctactcaggaggctgaggtgggaggactgcctgagcctttggaggtcgaggctgcagtgagctgtgattgagccactgcactccagcctgggtgagagagcgagaccttgtctcaaaaaatgaatattgtactataatgttaagtattaatagttttcatgttagatgataagaggataagagagggaacaaaacaaatacttgtgatgtatatgcatatatatttatatatccacacacgtatgcctaataaaataaggaagaaatactcataaaaattacagtcctgtagccaggggcagtggtgcacgcctgtagtcccagctacttgggcgactgagggaagaggatccagtccagcctgggtaacgaagcaagaccttacctctaaaaaaaatgatatattggccgggtgcagtagctcatgcctgtaatcccagcattttgggaggccaaggtgggcagatcatctgaggtcaggagttccagagcaatctgaccaacatggtgaaaccttgtctctactgaaaagaaaaaattagctgcacgtggtggtgcatccctgtaatcccagctactcaggaggctgagacaggagaaccgcttgaacccaggaggcggaggttgcagtgagccgagatcgcgccattgcactccaacctgggcaacaagagcgaaactccgtctcaaaaaaaaaaagttatatatttatatatagtcgtaatttatgcagctggtcacatggtcatagctggtatttataactgccttcttctacccattccagatccctttgccctcagcagacacctgagctgcttctttacccgatggggtgacccaaacctttattattgcagagtctgggtgtattagtctgttctcatgctgctaataaagacatacccaagacttggtaatttgtaaaggaaagaggtttagttggctcatggttccacatggctgaggaggcctcacaatcatggcggaaggcaaaagaggagcaaagtcacatcttacatggtggcaggcaagagagcatgtgcaggggaactcccctttataaaatcatccattcttgtgagacttattcactatcatgagaacagcacaggaaagacctgcctccatgattcaattacctcccactgggtccctcccacaacacatgggaattgtgggagcaacaattcaagatgagatttgggtggggacacagccaaaccctatcagcaagctactgttagtcctgcctgaattgggttgttgtagttttcaattgactttaatcacagggcattgtagtgtgctttaaggggtcttctgtgttccaggcctactcttctttatcttcattgtttaatagcaacccagtttctttttttctttctttttttttttttttttttgagatggagtctcactctgttgcccaggctggagtgcagtgatgtgatcttagctaaccacaacctccgcctcccaggttcaagtgattctcctgcctcagcctcccaagtagctgggattacaggcatgcaacaccatgcctgcctaatttttttatttttttattttttttgagatggagtcttgttgtcacccaggctgggagtgcagtagcacaatctcggctcactgcaacctccgcctcctgggttcaagcgattctcctgcctcagccttccaagtagctgggactacaggtgcctgccaccatgcccagctaatttttgtatttttagtagagacagagtttcaccatgttggccagggtagcctagaactcctgacctcaaatgatctgcccgccttggcctcccaaattgctgggattacaggcgtgagccaccgtgccctgctgcaagccaatttcatcttggtagttaggatcagatgctccagccaatacagcaactcccttcttttcctgttgcttcagaggcatgagaagccttaagtggccgtgtggcagtcttagcttccagttcaatgaaatcactgttgtatctcttggtggaagctttcctccttttggaacagagacccctacaccagtggagcataatatcatgaaggtaggaaataaaaattttgctagtaggttactaggggtaatagtgagtagtgccatttgcatttctgtttgtttttgtgtttttttttgagacggagtcttgctctgttgcccaggctggagtgcactggcatgatctcagctcactgcaacctcctccacctgggttcaagtgactctcctgcctcagcctcctgagtagctgggagccatttgcatttttacctccttgattcctggacctgtgaatcctggctatgggagaaatcacaccatatattaaatgcggattcagagaatattcagactcctgcaggacattgccccagcccagcaaggtattgccacctagctggcactgtaactgagtcttcaaaaagcatggtgaggaacatggtgagacttgtgaattccatgagcatggtcccattgccccactccttttgctgtgaaataagttccttggtcagaagcaatgctttgtggaataccatgatggtggatttcctttgttgcataacccatgtattcattcctttactttcagctattatttctttttttatttctttttctttttctttttttttgagagagagtcttgctttgtctctcaggctggaggctggagtatagtggcacaatctcgtctcaatacaacctccacctcctgggttcaagcgattctcctgcctttgcctcccgagtagctgggattacaggctcatgccaccacacccagctaatttgtgtgtgtgtgtgtgtttttttagatgaagtctcactcttgtcactcaggctggaatgcaatggtgcgatcttggttcactgcaacccctgcctcccaggcccaagcgattcttctgcctcagcctcccgagtagctgggattacaggcgcctgccaccatgcccagtatttttagtagagacagggtttcaccatgttggccaggctggtctcgaactcctgacctcaggcaatctgcccgcctcagcctctcaaagtgctgggattacaggagtgagccactgcacctggcctgtattttttagtagagacggggtttcgccatgttggccaggctggtctcgaactcatgagctcaggtaatccgcccgccttggcctcccaaagtgctgggattacaggtgtgagccaccgtgtccagcctattctttctatttctctctatttgtcactgatttctacccacacactgttctggtccaggttgctggcaacaatattggtctagcaaatgcctccccattggtcttttcccattcatatagcatatggttatattggtaccaaactcatggggtatctcaaccactagacagtgcatctggattcactgtcaaccgcaattttgtcagatggggtgaaggcacaatctatctcattaggcccataggaattttggcatatatatatttttaaagtatagttacagattcttgctaaggatcatctctgcttccagcacccacagttgtagccctggtcctggaaccattgcaacaaggagtaagaaagaaagtttaggtaatataggggagaattgtatagtcatattagcatcctcccccatcacctttacacctcatctctcagaaaagtggaggaatctcggaatctatctagcaagaatgttccattgattctgctcatgttgactgtgagcacaaacttgggaaggtgtgtaagccagctctttaagcccatgtctcctctctctttctctctctctctgtctcttttttgagacagggtttgggtctgttgcccaggctgcagtgcagtggtgtaaccttggctcactgcaacctcagcctccagggctgaagcaatcctcccacttcagcctcctgagcagctaggtttacaggcatacaccatcatgcctagttaatttttggaatttttggtagagatgtggtctccctatgttgcccaggctggcctcagattcttgagctcaagtgatcctcctgcctcagcctcccaaagtgttggtattacaggcatgagccacattgcccagtttctgttctctctctctttttttttttttttttttgagacagagtcttgctctgtcacccaggctggagtgcagtggcgcaatttcggctcaccacaacctctgcctcccggatttcagtgattctcgtgcctcagcctcccaagtagctgggactacaggcacgcaccaccacacccagctaatttttatatttttagtagagacggtgtttcatcatgttggtcaggctggtcttgaactcctgacctcaggtgatctgcctgcctgccttggcctcccaaagtgctgggattacaggcgtgagccactgtgcccagcctttcctgtctctctctatctctcttattattattattattttagagacagggtctagctatgttgccaaggctcgtctcaaactcttgggctcaagggatcctcccaagtcggcttcccaaagtgctgggattataggcatgagctactggacccagcgtttgacagatgttttaattgtccattccaattctgtgcaaaactacaactctgaggatgatatgcaacataatatgtccatttggtgttttatctttttgcccattgttggatactatgctgtaaggtgtgttccttgatctgaagagatgtaacatggcagtctaaattggtgtagtatcttctgtttcttttcttttctcttctttctttttcaagacagagccttgctctgtaaccaaggtggagagcagtggtgctatcagggctcactgcagcctcgacctcctaggctcaggcgatcctcccgcctcagccacctgagtagctggaactacaggcatgtgccaccgtgcctggctaattttttatattttttgtagagatgggttctccctgtgttctccaggctggtcttgaactcctggcctaaagcagtcctcccatctcggcctcccaaagtactgggactataggcatgagaccctgtgctcagtcatgagagctgttcatagggtgccatccatgtggcagtaggagctgtcagttcctctggtggtttcaaagttggtcttagaggaaatgctgaatacgatgagtactgccttgcaatcctccagtagcatgtcctcgtataaactgtttgcattatattatggaactcttctgggcattgccttccttattagaatgtttctctgacatcacctaggacattatgggtatttcaggtttcaagattattttatctttcattcacaaaaaaatcaccataccaccacatctggaaattctctgatccaaaacctcagccattgctgttgggtagcactcacaggcttttgccacaatctccagtctctataaatacaagttgcagacattttcaaaatcatgtctgcctgtggatcttatataagggctcaaaagcatcaagagagtgtctgctctttgcaattcagacatagcctgcgtaaatatggccttcttttgtgctgtttaatggagggaagctagcaatattctcagatgtggaacatgcatcctgcaaatgacaagtaacctgattaggtactgtgtttctcacgtagtaccaggggtagtaggcagtgacagcagttcatttttttcttgcttggggaatgttaggggtggatcctgcccaggttattcctaagaatttcaccatttgagtgggcctttggatttttgtcgcatttatcaaccacctctgttggtcatgtatgtcactattctatttaagtcagtcctagcttgctcttcagttttttgttttttgagacaaggtctcactatgttgcccaggccagagtgcagtggcacaatcacagttcactgcggcctccacctctctgccccaagcaaacctcccacctcagcctcccaggtagctaggaccacaggtgtgtgccatcacacccactaattttttatatttggagagacagggtctcactatgttgcccaggctggtcttgaactcctgggctcaagcagtcctcccgcttcggcctctcaaagtgctgggattacaggcaagagccaccatgcctgaccgagaacggtagctttatagtaagtgttgaaattaggtatataaatcctctagcttttttcttccttttcaaaattgctttggctgttcgaggcccttttaatttccatatgaattttagaagcagcttgtcaatttctaattattaattttgttttattgattgtgatcaatgttgtttgtaacatatgtatcttaaggaacctaccgaagttgttttctttgtgccctagtatttgaccaaattttgtgaatattttatgtgcacgtgagaaaaagtatattctgtatgatcagggatccaaaagatcaaccttactgattatgtggtttaggtcttttatattattacttatattttgtctatttaatctgtctcattctgtgaatggtatgttaaaagtctcccattagagaatatttctatttcttctttcattcttgtagttttcggcttatataggctgttgatgttactttattgtttgcatttgataaattttttaatttttttttttttttggagtcagagtcttgctctgtcgcccaggccggagtgcagtggtatgatctcagctcactgcaagctccgcctcccgggttcacgccattctcttgcctcagcctcccgagtagctgggtctacaggcgcccgccaccacgcccggctaatttttgtttgtagttttagtagacatggggtttcaccgtgttacccaggatggtctccatctcctgaccttgtgatccgcctgtctcggcctcccaaagtgctgggattacaggcgtgagccaccgtgcccggcctaaagattttgtatggatttagaggatacaagtacagctttgttacatgcgtatattgcagagtggtgaagtctgggcttttagtgtcaccatcacctgaatagggtacattaaatcagatgattaaataagctccagactgggcacagtggctcatgcctgtaatcctagcactttgggaggccgaggcaggtggatcacctgaaatcaggagttcgagaccagcctggccaacatggtgaaaccctgtctctactgaaaatacacacacacacacacacacaaattagctgggtgtggtggcagacacctgtaatcccagctactagagaggctgaggcaggagaatcacttgaacccaggaaacagagattgcagtgagccgagatcacgctactgcactccagcctgggcaacaagagtgaaactctgtctcgaaaaacaaacaaaaaaataagctccagagtcttgtactataataccccagtatctagttattattattttttgagatggggtctcactcttgtcacccaggttagagtgcagtggcaggatctcggctcactggaacctcgactgcctgggctcaggtgattctcccacgtcagcctcataagtagctgagactacaagtgtgcaccaccacacctggctaatttattgtatttttagtagagactgggttttgctctgttgcttaggcttgtctcgaactcctgggctcaattgatctgcctgcctcagcctcccaaagtgctgggatacaggcatgagctacctcacctgaccaagatattgtttactcattatacaaaaatccaaaagttatatcaagaaccaggaacatttcaatttgaatgagaaaaaaatcaatgggtgccagcactgagatgatacagagtttagaattacttgacaaggattttaaagcagccatcataaaaatacttcaacaattatgaacacactcaaaacaaactttttaagaaagttttcataaaaaaatagaaatccccagcaaagaaataaaagacataaaaagttgccgggcacagaggctcacgcctgtaatcccagcagtttgggaggccgaggcgggcagatcacttgaggtcaggagttggagaccagcatggccaacatggtgaaaccctgtctctactaaaaatacaaaaattagctgggtgtggtggtaagcgcctgtaatcccagctacttgggagtctgaggcatgagaattgcttgaacctgggaggtggaggttgcagtgagctgagatggagccactgcactgcagcctgtgcggcagagccagactgtttgtttgtttgtttgttttgagatagagtctcactctgttgcccaggctggagtgcagtggcttgatatcggctcactgcaacctccatctctcaggttcaatcgattctgccccctcggcctccctgtagctgggattacaggcgcgcaccaccatgccctgctaatttttgtatttttagtaaagatgggatttcaccatgttggccaggctggtctcagacccctgacctcaggtgatctgcttgcctcggcctcccaaaatgctgggattacaggcttgagccaccgcacctggcagacagagggagaatctgtctgaaacaaacaaacagccataaaaagtaaccaaatggaaattttagaaattaaaaatacaataatcaaaatggaaactcagaaatggactcgacagcagaatgcagatgaaaaaggaatcaatgaacttaagcatagaaaaaagcctgcattatctatatataaatgagtgactgaatatgatgttgtgaaccataatgccagtctagatatctagacttgggtttcaggtatggctttctctaattcctaaccaagtgccctggatattattcttattctctattgtcttgactttgtttatttattatttatttttttaaatttttttttgacttttattttaggtttcgggtactgtattagtctgttctcacactcctataaagaacgacctgggtagtttataaagaatagaggtttaattgacttatggttccacaggctggacaggcttctgcttttggggaggactcaggaaacttacaattatggtggaaagtgaaggggaagcaaggcatgtctcacatggcagcaggagagagagagcaaagggggaagtgccacacactaaacaaccagatcttgtgagaactcaatcactatcacaagaagaagggggaggccggacgtggtggctcacatctgtaatcccagcactttgggaagctgaggcgggtagatcacctgaggtcaggagttcaagaccagcctggccaacatggtgaaaccccatttctactaaaaatacaaaaaattagctgggcatgatggcatgcgcctgtaatcccagctactcaggaggctgaggcaggagaatcgcttgaacctcagaggtggaggttgcagtgagccaagattgcaccattgcactccagcctcagcaacaagagcaaaactctgtcttgaaaaaaaaaaaatgaacaagggggaaatccacccccatgttccaatcacttcccagcaggcccctcctccaacgctgaagatcataattcaacatgagatttgcatggggtcacagagccaaaccacatcaggaacatgtgcaagtttattaggcatttggtaaatttttgtccaaccctttaattttagccttttgcatgactgtgttttaatcatgtctcttgtatgcagcatagtgctgggctttgctttatgaggcaatattaaaccctttttattttatttatttttttgattgtataggtttttattttattactcacctaaacattgctgacccatcaatagaacagcccagccagacatacgtaatagtaatcaaatacatttgtcttttgtactttgcttttacatggaaaacatagcttttacatatttttaggtttttttcatttttatttttcagtttcttttttatttcaataggttttggggaatggttggtgtttggttacatgaagaagttctgtagtggtgacttcaaagattttggtgcacccatcacacaagcagtatacccaatgtgtagtcttttatccctacccccctaccctttcttctcagtccccaaagtccattgtatcattcttatgcctttgtgtcctcatagctttgctttaatgttttattaaaaatattattattattattttaaatagatagagttggtatcttcctatgttggccaggatggtcttgaactcctggcctcaagcaatcctcccacatcagcctcccaaagtgctaggattataggtgtgagccaccacatttggctccctttttcctttaataagcgaattaagcccattcgtatttattcgcgttactgttaagcttggtctcaattctctcattttattttatgttataatcactgtggtatatattttatttactgtatttctttctctctctctctctctctttttctttttttgagacagagtctcactctgtcacccagactggagtgcagtggcgagatcttggctcaatgcaactttggcctccccggttgaagcgattctcctgcctcagcctcctgagtagctgggattacaggcacgcaccactacacctggctaattttaaaaatttttagtagagacagggtttcgccatgttggctaggctggtcttgaactcctgacctcagctgatatgcctgcctgggcctcccaaagtgctgggattacaggcgtgagccactatgcccggccgaaacatgattgacttcgatgagttgactttgtgtcctgcagtcttgctaagagcttctttgtagattccttaggattttctacatagacaatcatattgtgtgagaacagagacagttttatttattctttccaaccagttatatgccttttatttcctttttcttgcctgatttcactaaagtaggactttgaataggattttgatttcgaataggattcgtaaaagtggacgtctcttgcctttttcctgatcttctagggaaagcattcagtctttttcattacatatgatgttagctgtaggtttttggtagatgatctttatcaggttaaagaagtttccttctattcctactttgatgagaggttttgtcaggaatgaatgttgaattttgtcaaatgacttttctatatcaattgatgattgtgtggtttttctgttttagtttcttaatatggtggattatattgattgatttaaaaatgttcagccagcctcacgttctctggataaacaccaactgatcatgctatgtgtttacatatgttgcttgatttgatttgctaatatttgttgaggctttttacttctatgtttataagggatattggactgcaattttcttttcttgtcatgtctttgtctgattttgtaatcaggataatgatggcctcataaaatgagaagtgtccttgtctagaaaatggaagaggaaagactgtatagaattgatgtattccttaaatatttggtagaatttactagtgaaactatcaaggcctgggaatttcttttttggaaggttttaaaccacaagttcagtttatttaattgatattccattcagttgtctgtttctctttgggtaagttttggtgttttgtatatttcatggaattggtccatttcatctaagttggtgaatttatgtgaataaaaatgttcgtggcattctcttactctcattttaatgtcgttagaggtatatagtaatatctctttgttttcttttctttttttctttttttttgagatggagcttggctcactgcaacctccacctcccgggttcaagcaattctcctgcctcagcctcccaagtggctgggattacaggcctgcaccaccatacccagctcatttcttacctatcactttaaactggaaatggcactgttacttgaaagtgtctcccctcctaccttccaacaccccacactttcctggttctatttctaccatctaataattgtattagtctgttcttgcattgctataaagaaatacctgagactgggtaacttataaagaaaagagatttaattggctcatggttctgcaggctgtacaaaaagcataacggcttctggggaggcctcaggaaacttccaatccatggcagaaggcaaagaggaagaaggaagaaatttttttttttttttagacggagtttcactcttgtcacccaggctagagtgcaagggcacgatctcggctcattgcaacctccgcctcctgggttcaagtgattcctgattctcctgcctcagcctcctgagtagctgggattacaggtgtgcaccaccatgccccgctaatttttgtattttagtagaaatggggtttcaccatgttggccaggctggtctcaaactcctgacctcaggtgatccacctacctcagtctcccaaagtgctgggattacaggcgtgagccaccgtgcccggaggcatatctttgtgtgtgtgtgtgtaagataggatctcgctctgtcacacaggctggagtgcagtggtgtgatcttggctcactgcagtctcaacctcctgggctcaagtgatcctcctgcctcagcccctcaagtagctgggattatagacatgcaccaccatgcccagctaatttttgtttgtttgtttgtagagacaggatttcaccatgttgcccagtctgctcaaattcctgggctcaagctgtccacctgcttcagcttcccaaagtgctgggattacaggcatgagccactgcgcccggacagcaggcacatcttacatggccagagcaggaggaattggggcacaggtgccacacactcttaaacaaccagatctcatgagaactcactatggcgatgacagcaccaagggaggatggtgttaaatcatgagaaaccacccccatgatccaatcccctcccaccaggccccacctccaacactggggattacaattcaacatgagatttgggtggagacacagatccaaaccatatcaggaatttactctgcaaccttcatagcatattggtgttccctcaaactctgtacttggtgcttctctcaaactgtgctccttcttagctatccaatttattctggtggtttcagctagtactggaatgatcttaccccccaaaccttggcctctgctagccttctctcttgagctccagctggacatctctgtcagtatgttccataaacactccaaagtctatctcagtttttcttccatgaactcattgtctctcctgttttgctaatgtctatacatggctccagcctcatcccagctgttcatgcagttatcctgggagcaatactgtctccctttctcccacagaacagcacttctgtatcatttataagtataaatatattttgtttctttgttttgagacagggtctctctgtcgcccaggctggagtgcagtgacgcaatctcagctcactgcaacctccacctcccgggttcaagtgattctcctgcctcaggctcccaagtagctgggatggcaggcacctgccaccatgcccggctaatttttttttttttgtatttttagtagagatagggtttcaccatgttggccaggctggtctcgaactcctgacctcaagtgatccgcctgcctcggcctcccaaagtgctacgatcataggcatgagccaccatgcccagccagcttctttttttttttttgagacggagtcttgctctgttgcccgagctggagtgcagtggtgtgatcttggctcactgcaacctccgcctcctgggttcaagtgattctcctgcctccgcctcctgagtagctgggactacagatgtgcaccaccacacccagctaatttttgtatttttagtagagatggggttcaccccatctctgttggccagtctggtcttgaactcctgatctcaggcaatccacccagcttggcctcccaaagtgctgggattacaggcgtgagccaccgcgcccagcctccttcttcattttttaacccagcaacttgcacacgtccaggcacatagtgtttgttttttcattggttttccagaaatatgcttactgaggcacatagtgttaactcaggagtgcagtgatctttttttcatgcattaataaattaacacagtaacagagctgttccaggtaccccccaccccaaaagtatatcaagcgagacacaaaatcaggtatccagtgtagctctatttagtcaactttcaacagggctccattgagaagattagttcctgcacatctttttcatgcatcccattctgatcattggagattgttattacaggggtccgtgtcattcgaggatgtggctgtggatttcacccgacaggagtggcacagactggaccctgctcagaggaccatgcacaaggatgtgatgctggagacctacagcaacctggcatctgtgggtgaggatgattgtccgtgtaactcctgagagcgtgtgtttcctttcttggttgctgtaacatgtgcagccttgcgagggtttaatgatattaagagtcacagatgagtaatcagtttagggcaccagaaaaaatgtgtgcgttcttacttccccaatgaaaggtttaaatgggcccccttccttgtgcagctcatgaagatgcaccttcctcctccatcagaggccctagagctcagacaacttggcccacgtcctgtgccatttcccattaacaggcctctgcgtggccaaaccagagatgatcttcaagttggagcgaggagaagagctgtggatattagaggaggaatcctcaggccatggttactcaggtaagtactgggcaagaactggacatatggaaaataggggaaataagagcccaggaattcaggtcaaagggtatgcttgtgcaacactttctaggaatctctttttagagttcctagctctttgaaaataaggacggaaggtctacatgcttcagataccaaagtcacacatcttaatatcacactcaaacttcagtgctttctccggttttatcttgattttttttttttttgatggagtctcactctgtcatccaggctggagtgcagtggtgcgatctcagctcaccacaacctccacctcccgggctcaagcgattctcctgcctcagcatcctgagcagctgggattacaggtgcgtgccaccacgcctggctaatttttgtacttttagtagagacagggtttcaccatgttggccaggttggtcacgaactcctgacctcaagtgatctgcctgccttggcctctcaaagtgctgggattacaggtgtgagccaccgcacctagcctttatcttgatttttaagttatttaccactcttatttatctctgcctcatcttaaacatttattcttttatttttttgagacagagtgtctctctgttgctcaggctcgagtgcagtggtgcaatcatggctcaacctcaacttaaaacctcacctgcccggtttaaacgacctttccagggcaacctccctagtagctgggactacaggcacgcaccaccatacctggctgatttttgtattattattattttttttttgtagagacagaatctcactatgttgcccaggctggtcttgaactcctgggctcaagtgatccacctgccatggcctcccgaagtgctagggtcagaggtatgagccaccacacctggcaacatttattctttcttccctccattgccttggatgctttctgttatcaggcattcattcatatattcatttagtcatccatgaaactttaaatgagtatcagttatatgctgtgtatgttctaggtgtgggaaactggtagtgaataaaataatatctctgttctcttggagcttacaatatagtgggggaaagtgaccagaaacaaacaaatacatcatatgtttgatggtgaaaagaaaatcagtgcaaggtaagaaggatagatactgatttttaggaaatagagggttttttgtttgtttgttttttgatggagtctcactctgtcgcccagactggagtacagtggtgcgatctcagctcactgtaacctccacctcctgggttcaagtgattctcttgcctcagcctcccgagtagctgggattacaggcgggcaccattatggccagctaatttttgtatttttagtagagatggagttttgccatgttgggcaggctgatctcaaactcctgacctcaagtgatccgcctgccttggcctcccaaagtgctgggattacaagcgtgagccactgtgcctggctggaatagagttttaaaggttgtgttaaggagtttaattttatactgtgacaagagaagccagtttgggattttacataaaagagtgacatgctgtgatttatttttaaaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtcatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcacacagtgtgcctgtgaaaatttggcacctacatttgtatcaaagtatgtcctgatccccttaggggatagctcattgtttttattcagatttccctaattagtggtgtgtgaacatcttatctgttgattggctatttgggttttttcttctgtgcattgactgttcatgtcctctgctcattgttttcaaatgggctgttcatctcttgctttttggtttaaatgttgttttttaacatatgagaatataaaaatcctttttttttcagtcatatgtgttgcaaatatcttctcccagactgtcgttggttttttaaattttgccatctgttttcttctgctgaagttttatattttatttatttattttttatttttttgagatggagtctcactctgtcacccaggctggagtgcaatggcatgacctcagctcatttcaaccttcgcctcccgggttcaagcgattctcctgcctcagtctcccaagtagctgggattacaggtgtgcaccaccatgcctggctaatttttgtatttttagtaaagacggggtttcaccatgttggccaggctggtctctaactcctgacctcaggtgatccacctgcctcggcctccaaaagtgttgggattacaggtgtgagccaccgtgc

SEQ ID NO: 3371 - DNA, 5606 bp, human
ctcataacctctgctgcagaatgccctcatgcaactgaagtctctctagagtttggaaatctttaccaacaaagaaaaattctgatgtattctctttcagttgaacatcctcagatgactttcggcaggctccagggaatcttcccgaaggtgagtgtctctcaaatctaaaggaccagagaacctttgtcccttcacgaatgtgaaccctgtaagagtgggagaatatcaacaatgccctcactgccttcttctccctatgtctatcacaacacctgatgtagcaccgacggcttgctaatactaacagttgtgatccttaatacttcttttgttttcatagtgatgccaaatactattttaagcagttcacatggatgaatttatttaatccttaagaagacattgtttctattatctccaaataataatgagtcacacacttcagttgtcacccatataaaaggcaggcgacttggcacaaatcttctaagtcctctgagctccggattcctggttcatgaaatggaagtaaagaatcatagttcatgttttagatcatagttatcagcagcataataataaaatgaggctatccgggtatagagatgttaaagaattttcctgaggcgcagtggcagtggtagtctaatccagagctccaagccatttaaagctcattcacatttgcatttgttatgaagttcagatgttgctcactagggcttcacccccgtagggcctcctggtgcttccattgagagacccactctcacaacaggaaggaccatctggtctctgatctgttactggggccacttgcatggcttaggaatcgctttgactgttggcccctccctactgtgagctccttgagggccttgtctgcacctggggcatccgggaagtcccagtcccagcccaggggatccctcggaggcccctgaattagtgaccctacaagtgcagattcaactctggtttagagggtaaagggatctgggagttgggttgccagtgtggagaccgaattcaaagaaggatcatgaaaggtattaattgttattattactacatttaaacagtgtttacaagctcagagaggccttcccttagcctattttacatgtattgttcactatttcataagtgaggaagctgaataaaaagtagcctaaggactgggcgtggtggctcacgactgtaatcccagcactttgggaggctgaggcgggcagatcatgaggtcaagcgatcgagatcatcctgcccaccatggtgaaacctcgtctctactaaaaatacaaaacttagcggggcgtggtagtgcctgcctgtagtcccagatactctggaggctaaggaaggagaatcgcttaaacatgggagttggatgttgcagtgagccgagatcctgccactgcactccagcctggcaaaagaacgagactccatccaaaaaaaaaaaaaagtagcttaagagtgttggtcagtgatacatcccaatgcaaccagaattgttatgggtaccacctcactgaattccacattcaatgttggtgcctcggtaggctggtatgccagatctggtactgctttctttgctgcctggattaatttcagcaaaccatttctttccctctcccttccctgtatacatctccccacaccatcttgttcagcagtgttttgtcccctctgtatgtctttacatttactctcccagcagctgtctacgagcttatatgggatcccttgtattttacggaaactcttccctttgtagaccttgtgaattcttagaatgctatgctccaaatcttctgtataccaaactctcaattacatggagatatttgctgtttgcaagaatgtcagtcttaaaacagtgtgaagataagaagaattctatccctggaaaccatattcagttaggccattcctttcccatctaacctcccctcccaggtttctcctaatttaggcaagtgtaactctcctagcattgttgagaacattgattaaggtaatgcatgtgaagattctttgtaagctctaaagcactaaagaaatgtcactgatactgtttatctgtgaccttcacattataaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggtaagagaaaagaatttgggaacaaccactctggcttttctcgctaagttcaggtgtgtggactgggtgtgtggcatggaccccagacaagcctgggtccaggctgggctgaggagctcgcccagctccagatgagatgttacacatgacttccagagacacagactggagttgtcattcatataaaaaaaccacgtgacttggggcaagtcttccaaattttcttagctccagtttcctagtttataagttggaaataaagaatctcagttcataaattgtttggaggcattaaattaagtctagaaggcctgatgacatgaaaggtgctgaagcaattccatctgtgattacctgggatcatatcttactcagctcaatgcctgttacccgatataggtgtacttcagagatattgcatgttcagttccagaccactgcgataaagtgagtcacacacatttttttcttggtttggcagtgcataaaaacattatgtttacaatatactgaagtctactaagtttgcactagcattgtgtctcaaaatgtatatatcttaattttaaaataattcattgtataaaatgctaataatcttctgcgacttcagtgagtcacactctttttgctggtggaggatcctgcctgggtgttgatggctgctggctgatcaaggtggtggttgctgaagggtggagtggctgtggcagtttcataaaagaagacaacaatgaaatttgccacatcgattagctcttccgttcatgaatgctttctctgtagtatgtgatgcttttggatagcattttacccacagtagaacttctttcaaagttgaagtcaatgctctctagctatgaaagtcctagatggcatctccttccaatagaaggctattttatctacattgaaaatctgttgtttagtgtagccaccttcatcagtgatcttagctagatcttccggataacttgctgcagcttctccatcagggtttgctgcttcaccttgcacttttatgttatggagacggcttctttccttaaacctcatgaaccaacctctgctagcttcacacgtttctcctgcagcttcttcacctctctcagaattcatggacttgaagagagtttgggtcttgccctgaattagactttggcttaagggaatgttgtggctggtttcgtcttctatcctgaccactttctcatttaagcagtaaggcagttttgctttcttattcttgtgttcactggagtattagtattattattttcttcaagaacttttcctttgcattatatactattacttccttcaagaacttttcctttgcattcacagcttggctgtttggtgcaagaggcttagctttcagcctgtcttggctttcagcatgcttcctcactaagcttagccatttctagcttctgatttaaagtgagagacatgcgactcttcctttcatttcaacacttagcggccattgtagggttgttaatcttcctaatttcggtgttgatatgtctcaggaaatacagatgcccaagaaaaggaagagaggcagggaagagctcatcggtggagcagtcagaacacacacaatatttgtcgattaagtttgtcaacttctatgagtgcagttcctgttacccccagaataattacatacaacagggtgattatagtcaataataacttaattgtgcagtatgaaaactaaaagagtgtaaatggattgattgtaaccaaggataaatgtttgaggggatagatcccttattttccatgatgtgatttttacgcatttgcatgcctgtatcaaaacgtctcatgtatcccataagtatatacacctactgtgtacccacaaaaataaaaaacagaaattattttaaaagactaaaaaacaataaaaacaattgcagtaataatatcaaagctcactgatcacaaatcaccataacagatataataataatggaaaagtgtaaaattggtgagaatttccaaaaaaaaaattgcaacatctgtgaagcagtatgaaaatgaggtgcaataaaacaaggtacgcctgtgtggccttaataaatacgtgctgaatgaaaggaggtaagggtgaatgttcccgtaagtgaagaggttgggaatctaaacctgacaacggaaggagccagaagctaaaactttaatttgcatttggcctgtattggtgtgggtctaaggtctcagcctctctaagccagagaatgtgaaaaactggataaagaagacccatgggcacttggtggtggggaggcatctccttttttggagaaaacagagcctaacactctccaatcaacccaaccctctccaatctacccaaccctcatcttccaactcttctccatcataggacccaaaagggggaaacatgcctggacccacagagtgcgtgagagaaagcaactggtgatttatgaagagatcagcgaccctcaggaagatgacgagtaactccgtaagtgaacctttggctcatctcccacatccttgcagatgtgctattctgttatggtactggtatcccatcttatcagttgttccccaaatcattcccttctcataattttctagggtacagcattgaggctgaatgatgaaatttcccatgtttttttttgtgggtgggggagtctccttttgttcccccaggctggagtgcagtggcatgatctcggctcactgcaagctccgcctcccgtgttcacgccattctcctgcctcagcctccccagtagctggggctacaagcacccgccaccacgaccgggtaattttttttcttgtatttttagtagagacagggtttcgccatgtcagccagaatggtctcaatctcctgacctcgtgatccatctgcctccgcctcccaaagtgttgtgactacaggcgtgagcctctgcgcctgcctaaccatgctctttctactccctgccctctatatccagggatcctccctacccaggatgctgtgggttcccaaaccccaggtcagcactgatatgcgggccacaccttcctctagcctaggaattgataacccaggcgaggaagtcactgtggtatgagcagatggttcacttcaaggaaccatggaaggcgtgtacaggtcctgaggtagggcagaatcggagtgggcagggtctgcaggtcaggaggagttgagattgagttgtcatgtggtgggaactcactgccacttactttccttctcgcttcttgcctcagcctcggggatatgacacatgcccatgatgagaagcagaacgtggtgacctttcacgaacatgggcatggctgcggatccct

SEQ ID NO: 3372 - DNA, 10543 bp, human
cgctctgattgtttcgattcttccaaaatcagagtaagcatttgctgattttctttttccattcttcctacccctcccctcctccgtggtgcatttgttatctagttttaataaggagtgtatatgaggcaggtcgccatctcaaatctttcctgtcagtttctaactttttcaagtatgggatttttcctgggaactctgcagtaacttaagaaatttgggcggggcgcggtggctcacacttgtaatcccagcagttttggaggccacagctggtggatcacttgaacctatgaggcggaggttgcagtgaccatgatcacgccagtgcaccccagcctgggcaacagagcaagaccttgtctgaccaaaaaaaaaaaaaaaaactcactcaaatctttcctcctgggctcaagtgatcctgttgcctaggccttgggactacaggtgcacaccatcccacttctgctaagggctaaggtgtttttattttgttttgttttagtagaaattgtttcgctatgttgaccaggctggtctcaagctcctgggctcaagtgatccgcccaccttggcctcccaaagtgctgggatggtacaggcctgctacaccacccccagctaactttttgtattttttgtagacacgagagttttgctatttttcccagcctggtcttgacctcctgggctcaagcgatctgcacgccttggcctcccaatgtgctgggattacaggagtgagccaccgagcctggctgattgtgcatgttgaaacaccccacattctctctaagtgttcccgggctcttgtagtctcagaaattctagctctcttccttctaataatttacaaatcacccagtaatagcttctaaatccgttcatagtagcgatgctcatttctcttcaacagaacagaacccccatccctctgcctgatcagatccatcaccagagagaccatgttatctctgggactcacttcccttcctttattcattgagtgagggtgtcagaacgcccccactgaataaaattacacagtcacatctctgccttcccaacaagggtctgtacatctttcagggtaagcctggcctcagggaaactactaacaacattagccaaccccctccaaagactcaaggctgctttgcccataggaaacatgtcatccccaatcaatacttctcccagagacccctggctccctgttttcatctgacttctccccatggccttactcagggacagataagccacggatggagaaatgcaactcctgattccaggtgactgagtgtggccagacttcactgatttctccctccatgggaccaaaggtcctgcagctggaaagactcagactgtttctcttgtaggacagagtgctcccggtgccatgaacggagacgatgcctttgtacggagacctagggttggttctcaaataccagagaagatgcaaaaggtgaggtgacctgcagggggcatagtagtggcccaggggacagtgtggggtgatcagttttctgaggaggggaggacagaggtactggggacaaggaccagggtctccggggacatctggaaccttgggagcctctcactctcgctctgtcatcacctagcatccctggagacaagtctgtgaccgtggaatacatttggtgaatctcagtccgttctggaaggtgggaagagagccagccagcagcattaaagctctactgtgtggcaggggagaagctagggtaggtgccccatgttctgtcagttagccatggcatcaaccaggacggattatcatccctacttcccagatccagcacacaggaagcggctccagctgaatggcagacatgcctagctgagtcactatcagaaatcctttttttttttctaggccttcgatgatattgccaaatacttctctgagaaagagtgggaaaagatgaaagcctcggagaaaatcatctatgtgtatatgaagagaaagtatgaggccatgactaaactaggtaacagaaagttctaggtacagacagtctggggatacatgagcatcccttttccagctttggctatttcttaggctgcagaaagtaccccacgttttccttttgtgcagggaaaaatggcaaggcagcttctgggtgctctgctcttctgtatcttgtcagggctgagggcagggactggccacagtggagctcatacctggatcctgcacgtttctctcccttaggagtctgttctgatgagcccaactgtctctgtggcatctggcacccccccatcgtccctaccttccttctctcggcttgtctctttcttttttttttttgacttagagtctcagtctgtcacctaggctagagtgcagtagtgcaatcatagctcactgcagcctcaaactcctggcctcaagcaatcctccagcttcagcctcccaaagagctgctactacagacatgagccaccataccaggcctaagcttgtctcttaaggaataaacattttgcttctttctaggtttcaaggccaccctcccacctttcatgcgtaataaacgggtcgcagacttccaggggaatgattttgataatgaccctaaccgtgggaatcagggtgagtagatgggaaggggctggaaagggtctcctcaagcgcaactgcttttcagctcagctacctgggaaagatcctcaggcatttgttccctcatacacatcagggctgagtgaaaaaaaaaaaattgcatgcagaaagttaactacagaggccattcatataaaattttaaaacatgcaaaacaagaatatgtatttttatagataataagtaagtggtaaatgtatacaaacatgaatgtgaataaaaagccatcaaattaaggtgactggctgtaagtggaggagggagggagggcgggcagggattgctgagtgcggcacagacagcttcagctgtgacttgttgatagtgtgttttgtgtgtttttgtttttgagatggagtttcactcttctcggccagggtggagtgcagtaaggcaatctcagctcactccaactttcacctcctgggttcaagtgattctcctgtctcagcctccagagtagctggggttacaggcgcccacccaaacgcccagctaattttttaatttttggtagagatggggtttcaccatgttggccaggctggtctcaaacttcctgacctcaggtgatccacccgccgcagcctcccaaagtgctgggattacaactgtgagttaccacgcccagcctgtttgtagtatttctaatattctgaataaataaatcagatctaaaatagctgtggggtaatgttgagatccgactggactcaatattattccccatacttttctgtgtgtttgaaatatttcttttttaaacgacatgttgttcttcctaagcactgttaatgaatcaaaggacagttaagaaaatgttacaagtgaaaaaaaaaaaagaaaatgttacaactgtagatccgccaaaaacttccagagtttgtttcattaacagcatgtgggtttgaataactatcttaggagtgaaggtgatgaacacattatgtaataagcactgctgtttccctgtattttatcaaaaccaaatagtcctctaattcccaaagaaccctgattctctgtgatgagctcgggagtgagtttgaaagagtgatccctcatccaacacacagagagctttcccacttgtcagtgaggagagataacatggggtgaaaaaaagacaggttcttcggtagagatctttgtacatttcagggatataaaggggacatatgtgtttacttgctcttctgctctgacaacacaattataagacaaggtcagaaagtccaaactgtctccaatagacctattactcgccaactaaacaggccagactctacaatctcccacaatcactataagagatctgaaaagccagtgcttgagtatctgccaagtttttgacgttaaaggactgtctttgtactgaaaatatttcagagccactggactaaatcatccatggttcatcacacatttaacagcttaattcacataccataagattcacccatttgaagtgtaaaatgattttcagttgttgtacatcttgagtggatacagttcagattcccaaccaatcaatttaattatttgagaataagtaaaagatatgtaatggaaaaagatgagactgtgatggggtttagtccccatgtgataaaccatgagatggaaaattctgaattgatgccacagataaatgcaccaaccatgactaaacataattcagaagcaaatctcaaataactcctcaacaatcagtggactcataacctctgctgcagaatgccctcatgcaactgaagtctctctagagtttggaaatctttaccaacaaagaaaaattctgatgtattctctttcagttgaacatcctcagatgactttcggcaggctccagggaatcttcccgaaggtgagtgtctctcaaatctaaaggaccagagaacctttgtcccttcacgaatgtgaaccctgtaagagtgggagaatatcaacaatgccctcactgccttcttctccctatgtctatcacaacacctgatgtagcaccgacggcttgctaatactaacagttgtgatccttaatacttcttttgttttcatagtgatgccaaatactattttaagcagttcacatggatgaatttatttaatccttaagaagacattgtttctattatctccaaataataatgagtcacacacttcagttgtcacccatataaaaggcaggcgacttggcacaaatcttctaagtcctctgagctccggattcctggttcatgaaatggaagtaaagaatcatagttcatgttttagatcatagttatcagcagcataataataaaatgaggctatccgggtatagagatgttaaagaattttcctgaggcgcagtggcagtggtagtctaatccagagctccaagccatttaaagctcattcacatttgcatttgttatgaagttcagatgttgctcactagggcttcacccccgtagggcctcctggtgcttccattgagagacccactctcacaacaggaaggaccatctggtctctgatctgttactggggccacttgcatggcttaggaatcgctttgactgttggcccctccctactgtgagctccttgagggccttgtctgcacctggggcatccgggaagtcccagtcccagcccaggggatccctcggaggcccctgaattagtgaccctacaagtgcagattcaactctggtttagagggtaaagggatctgggagttgggttgccagtgtggagaccgaattcaaagaaggatcatgaaaggtattaattgttattattactacatttaaacagtgtttacaagctcagagaggccttcccttagcctattttacatgtattgttcactatttcataagtgaggaagctgaataaaaagtagcctaaggactgggcgtggtggctcacgactgtaatcccagcactttgggaggctgaggcgggcagatcatgaggtcaagcgatcgagatcatcctgcccaccatggtgaaacctcgtctctactaaaaatacaaaacttagcggggcgtggtagtgcctgcctgtagtcccagatactctggaggctaaggaaggagaatcgcttaaacatgggagttggatgttgcagtgagccgagatcctgccactgcactccagcctggcaaaagaacgagactccatccaaaaaaaaaaaaaagtagcttaagagtgttggtcagtgatacatcccaatgcaaccagaattgttatgggtaccacctcactgaattccacattcaatgttggtgcctcggtaggctggtatgccagatctggtactgctttctttgctgcctggattaatttcagcaaaccatttctttccctctcccttccctgtatacatctccccacaccatcttgttcagcagtgttttgtcccctctgtatgtctttacatttactctcccagcagctgtctacgagcttatatgggatcccttgtattttacggaaactcttccctttgtagaccttgtgaattcttagaatgctatgctccaaatcttctgtataccaaactctcaattacatggagatatttgctgtttgcaagaatgtcagtcttaaaacagtgtgaagataagaagaattctatccctggaaaccatattcagttaggccattcctttcccatctaacctcccctcccaggtttctcctaatttaggcaagtgtaactctcctagcattgttgagaacattgattaaggtaatgcatgtgaagattctttgtaagctctaaagcactaaagaaatgtcactgatactgtttatctgtgaccttcacattataaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggtaagagaaaagaatttgggaacaaccactctggcttttctcgctaagttcaggtgtgtggactgggtgtgtggcatggaccccagacaagcctgggtccaggctgggctgaggagctcgcccagctccagatgagatgttacacatgacttccagagacacagactggagttgtcattcatataaaaaaaccacgtgacttggggcaagtcttccaaattttcttagctccagtttcctagtttataagttggaaataaagaatctcagttcataaattgtttggaggcattaaattaagtctagaaggcctgatgacatgaaaggtgctgaagcaattccatctgtgattacctgggatcatatcttactcagctcaatgcctgttacccgatataggtgtacttcagagatattgcatgttcagttccagaccactgcgataaagtgagtcacacacatttttttcttggtttggcagtgcataaaaacattatgtttacaatatactgaagtctactaagtttgcactagcattgtgtctcaaaatgtatatatcttaattttaaaataattcattgtataaaatgctaataatcttctgcgacttcagtgagtcacactctttttgctggtggaggatcctgcctgggtgttgatggctgctggctgatcaaggtggtggttgctgaagggtggagtggctgtggcagtttcataaaagaagacaacaatgaaatttgccacatcgattagctcttccgttcatgaatgctttctctgtagtatgtgatgcttttggatagcattttacccacagtagaacttctttcaaagttgaagtcaatgctctctagctatgaaagtcctagatggcatctccttccaatagaaggctattttatctacattgaaaatctgttgtttagtgtagccaccttcatcagtgatcttagctagatcttccggataacttgctgcagcttctccatcagggtttgctgcttcaccttgcacttttatgttatggagacggcttctttccttaaacctcatgaaccaacctctgctagcttcacacgtttctcctgcagcttcttcacctctctcagaattcatggacttgaagagagtttgggtcttgccctgaattagactttggcttaagggaatgttgtggctggtttcgtcttctatcctgaccactttctcatttaagcagtaaggcagttttgctttcttattcttgtgttcactggagtattagtattattattttcttcaagaacttttcctttgcattatatactattacttccttcaagaacttttcctttgcattcacagcttggctgtttggtgcaagaggcttagctttcagcctgtcttggctttcagcatgcttcctcactaagcttagccatttctagcttctgatttaaagtgagagacatgcgactcttcctttcatttcaacacttagcggccattgtagggttgttaatcttcctaatttcggtgttgatatgtctcaggaaatacagatgcccaagaaaaggaagagaggcagggaagagctcatcggtggagcagtcagaacacacacaatatttgtcgattaagtttgtcaacttctatgagtgcagttcctgttacccccagaataattacatacaacagggtgattatagtcaataataacttaattgtgcagtatgaaaactaaaagagtgtaaatggattgattgtaaccaaggataaatgtttgaggggatagatcccttattttccatgatgtgatttttacgcatttgcatgcctgtatcaaaacgtctcatgtatcccataagtatatacacctactgtgtacccacaaaaataaaaaacagaaattattttaaaagactaaaaaacaataaaaacaattgcagtaataatatcaaagctcactgatcacaaatcaccataacagatataataataatggaaaagtgtaaaattggtgagaatttccaaaaaaaaaattgcaacatctgtgaagcagtatgaaaatgaggtgcaataaaacaaggtacgcctgtgtggccttaataaatacgtgctgaatgaaaggaggtaagggtgaatgttcccgtaagtgaagaggttgggaatctaaacctgacaacggaaggagccagaagctaaaactttaatttgcatttggcctgtattggtgtgggtctaaggtctcagcctctctaagccagagaatgtgaaaaactggataaagaagacccatgggcacttggtggtggggaggcatctccttttttggagaaaacagagcctaacactctccaatcaacccaaccctctccaatctacccaaccctcatcttccaactcttctccatcataggacccaaaagggggaaacatgcctggacccacagagtgcgtgagagaaagcaactggtgatttatgaagagatcagcgaccctcaggaagatgacgagtaactccgtaagtgaacctttggctcatctcccacatccttgcagatgtgctattctgttatggtactggtatcccatcttatcagttgttccccaaatcattcccttctcataattttctagggtacagcattgaggctgaatgatgaaatttcccatgtttttttttgtgggtgggggagtctccttttgttcccccaggctggagtgcagtggcatgatctcggctcactgcaagctccgcctcccgtgttcacgccattctcctgcctcagcctccccagtagctggggctacaagcacccgccaccacgaccgggtaattttttttcttgtatttttagtagagacagggtttcgccatgtcagccagaatggtctcaatctcctgacctcgtgatccatctgcctccgcctcccaaagtgttgtgactacaggcgtgagcctctgcgcctgcctaaccatgctctttctactccctgccctctatatccagggatcctccctacccaggatgctgtgggttcccaaaccccaggtcagcactgatatgcgggccacaccttcctctagcctaggaattgataacccaggcgaggaagtcactgtggtatgagcagatggttcacttcaaggaaccatggaaggcgtgtacaggtcctgaggtagggcagaatcggagtgggcagggtctgcaggtcaggaggagttgagattgagttgtcatgtggtgggaactcactgccacttactttccttctcgcttcttgcctcagcctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgt

SEQ ID NO: 3373 - DNA, 10543 bp, human; identical to SEQ ID NO: 3372

SEQ ID NO: 3374 - DNA, 9138 bp, human
atgaacggagacgatgcctttgtacggagacctagggttggttctcaaataccagagaagatgcaaaaggtgaggtgacctgcagggggcatagtagtggcccaggggacagtgtggggtgatcagttttctgaggaggggaggacagaggtactggggacaaggaccagggtctccggggacatctggaaccttgggagcctctcactctcgctctgtcatcacctagcatccctggagacaagtctgtgaccgtggaatacatttggtgaatctcagtccgttctggaaggtgggaagagagccagccagcagcattaaagctctactgtgtggcaggggagaagctagggtaggtgccccatgttctgtcagttagccatggcatcaaccaggacggattatcatccctacttcccagatccagcacacaggaagcggctccagctgaatggcagacatgcctagctgagtcactatcagaaatcctttttttttttctaggccttcgatgatattgccaaatacttctctgagaaagagtgggaaaagatgaaagcctcggagaaaatcatctatgtgtatatgaagagaaagtatgaggccatgactaaactaggtaacagaaagttctaggtacagacagtctggggatacatgagcatcccttttccagctttggctatttcttaggctgcagaaagtaccccacgttttccttttgtgcagggaaaaatggcaaggcagcttctgggtgctctgctcttctgtatcttgtcagggctgagggcagggactggccacagtggagctcatacctggatcctgcacgtttctctcccttaggagtctgttctgatgagcccaactgtctctgtggcatctggcacccccccatcgtccctaccttccttctctcggcttgtctctttcttttttttttttgacttagagtctcagtctgtcacctaggctagagtgcagtagtgcaatcatagctcactgcagcctcaaactcctggcctcaagcaatcctccagcttcagcctcccaaagagctgctactacagacatgagccaccataccaggcctaagcttgtctcttaaggaataaacattttgcttctttctaggtttcaaggccaccctcccacctttcatgcgtaataaacgggtcgcagacttccaggggaatgattttgataatgaccctaaccgtgggaatcagggtgagtagatgggaaggggctggaaagggtctcctcaagcgcaactgcttttcagctcagctacctgggaaagatcctcaggcatttgttccctcatacacatcagggctgagtgaaaaaaaaaaaattgcatgcagaaagttaactacagaggccattcatataaaattttaaaacatgcaaaacaagaatatgtatttttatagataataagtaagtggtaaatgtatacaaacatgaatgtgaataaaaagccatcaaattaaggtgactggctgtaagtggaggagggagggagggcgggcagggattgctgagtgcggcacagacagcttcagctgtgacttgttgatagtgtgttttgtgtgtttttgtttttgagatggagtttcactcttctcggccagggtggagtgcagtaaggcaatctcagctcactccaactttcacctcctgggttcaagtgattctcctgtctcagcctccagagtagctggggttacaggcgcccacccaaacgcccagctaattttttaatttttggtagagatggggtttcaccatgttggccaggctggtctcaaacttcctgacctcaggtgatccacccgccgcagcctcccaaagtgctgggattacaactgtgagttaccacgcccagcctgtttgtagtatttctaatattctgaataaataaatcagatctaaaatagctgtggggtaatgttgagatccgactggactcaatattattccccatacttttctgtgtgtttgaaatatttcttttttaaacgacatgttgttcttcctaagcactgttaatgaatcaaaggacagttaagaaaatgttacaagtgaaaaaaaaaaaagaaaatgttacaactgtagatccgccaaaaacttccagagtttgtttcattaacagcatgtgggtttgaataactatcttaggagtgaaggtgatgaacacattatgtaataagcactgctgtttccctgtattttatcaaaaccaaatagtcctctaattcccaaagaaccctgattctctgtgatgagctcgggagtgagtttgaaagagtgatccctcatccaacacacagagagctttcccacttgtcagtgaggagagataacatggggtgaaaaaaagacaggttcttcggtagagatctttgtacatttcagggatataaaggggacatatgtgtttacttgctcttctgctctgacaacacaattataagacaaggtcagaaagtccaaactgtctccaatagacctattactcgccaactaaacaggccagactctacaatctcccacaatcactataagagatctgaaaagccagtgcttgagtatctgccaagtttttgacgttaaaggactgtctttgtactgaaaatatttcagagccactggactaaatcatccatggttcatcacacatttaacagcttaattcacataccataagattcacccatttgaagtgtaaaatgattttcagttgttgtacatcttgagtggatacagttcagattcccaaccaatcaatttaattatttgagaataagtaaaagatatgtaatggaaaaagatgagactgtgatggggtttagtccccatgtgataaaccatgagatggaaaattctgaattgatgccacagataaatgcaccaaccatgactaaacataattcagaagcaaatctcaaataactcctcaacaatcagtggactcataacctctgctgcagaatgccctcatgcaactgaagtctctctagagtttggaaatctttaccaacaaagaaaaattctgatgtattctctttcagttgaacatcctcagatgactttcggcaggctccagggaatcttcccgaaggtgagtgtctctcaaatctaaaggaccagagaacctttgtcccttcacgaatgtgaaccctgtaagagtgggagaatatcaacaatgccctcactgccttcttctccctatgtctatcacaacacctgatgtagcaccgacggcttgctaatactaacagttgtgatccttaatacttcttttgttttcatagtgatgccaaatactattttaagcagttcacatggatgaatttatttaatccttaagaagacattgtttctattatctccaaataataatgagtcacacacttcagttgtcacccatataaaaggcaggcgacttggcacaaatcttctaagtcctctgagctccggattcctggttcatgaaatggaagtaaagaatcatagttcatgttttagatcatagttatcagcagcataataataaaatgaggctatccgggtatagagatgttaaagaattttcctgaggcgcagtggcagtggtagtctaatccagagctccaagccatttaaagctcattcacatttgcatttgttatgaagttcagatgttgctcactagggcttcacccccgtagggcctcctggtgcttccattgagagacccactctcacaacaggaaggaccatctggtctctgatctgttactggggccacttgcatggcttaggaatcgctttgactgttggcccctccctactgtgagctccttgagggccttgtctgcacctggggcatccgggaagtcccagtcccagcccaggggatccctcggaggcccctgaattagtgaccctacaagtgcagattcaactctggtttagagggtaaagggatctgggagttgggttgccagtgtggagaccgaattcaaagaaggatcatgaaaggtattaattgttattattactacatttaaacagtgtttacaagctcagagaggccttcccttagcctattttacatgtattgttcactatttcataagtgaggaagctgaataaaaagtagcctaaggactgggcgtggtggctcacgactgtaatcccagcactttgggaggctgaggcgggcagatcatgaggtcaagcgatcgagatcatcctgcccaccatggtgaaacctcgtctctactaaaaatacaaaacttagcggggcgtggtagtgcctgcctgtagtcccagatactctggaggctaaggaaggagaatcgcttaaacatgggagttggatgttgcagtgagccgagatcctgccactgcactccagcctggcaaaagaacgagactccatccaaaaaaaaaaaaaagtagcttaagagtgttggtcagtgatacatcccaatgcaaccagaattgttatgggtaccacctcactgaattccacattcaatgttggtgcctcggtaggctggtatgccagatctggtactgctttctttgctgcctggattaatttcagcaaaccatttctttccctctcccttccctgtatacatctccccacaccatcttgttcagcagtgttttgtcccctctgtatgtctttacatttactctcccagcagctgtctacgagcttatatgggatcccttgtattttacggaaactcttccctttgtagaccttgtgaattcttagaatgctatgctccaaatcttctgtataccaaactctcaattacatggagatatttgctgtttgcaagaatgtcagtcttaaaacagtgtgaagataagaagaattctatccctggaaaccatattcagttaggccattcctttcccatctaacctcccctcccaggtttctcctaatttaggcaagtgtaactctcctagcattgttgagaacattgattaaggtaatgcatgtgaagattctttgtaagctctaaagcactaaagaaatgtcactgatactgtttatctgtgaccttcacattataaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggtaagagaaaagaatttgggaacaaccactctggcttttctcgctaagttcaggtgtgtggactgggtgtgtggcatggaccccagacaagcctgggtccaggctgggctgaggagctcgcccagctccagatgagatgttacacatgacttccagagacacagactggagttgtcattcatataaaaaaaccacgtgacttggggcaagtcttccaaattttcttagctccagtttcctagtttataagttggaaataaagaatctcagttcataaattgtttggaggcattaaattaagtctagaaggcctgatgacatgaaaggtgctgaagcaattccatctgtgattacctgggatcatatcttactcagctcaatgcctgttacccgatataggtgtacttcagagatattgcatgttcagttccagaccactgcgataaagtgagtcacacacatttttttcttggtttggcagtgcataaaaacattatgtttacaatatactgaagtctactaagtttgcactagcattgtgtctcaaaatgtatatatcttaattttaaaataattcattgtataaaatgctaataatcttctgcgacttcagtgagtcacactctttttgctggtggaggatcctgcctgggtgttgatggctgctggctgatcaaggtggtggttgctgaagggtggagtggctgtggcagtttcataaaagaagacaacaatgaaatttgccacatcgattagctcttccgttcatgaatgctttctctgtagtatgtgatgcttttggatagcattttacccacagtagaacttctttcaaagttgaagtcaatgctctctagctatgaaagtcctagatggcatctccttccaatagaaggctattttatctacattgaaaatctgttgtttagtgtagccaccttcatcagtgatcttagctagatcttccggataacttgctgcagcttctccatcagggtttgctgcttcaccttgcacttttatgttatggagacggcttctttccttaaacctcatgaaccaacctctgctagcttcacacgtttctcctgcagcttcttcacctctctcagaattcatggacttgaagagagtttgggtcttgccctgaattagactttggcttaagggaatgttgtggctggtttcgtcttctatcctgaccactttctcatttaagcagtaaggcagttttgctttcttattcttgtgttcactggagtattagtattattattttcttcaagaacttttcctttgcattatatactattacttccttcaagaacttttcctttgcattcacagcttggctgtttggtgcaagaggcttagctttcagcctgtcttggctttcagcatgcttcctcactaagcttagccatttctagcttctgatttaaagtgagagacatgcgactcttcctttcatttcaacacttagcggccattgtagggttgttaatcttcctaatttcggtgttgatatgtctcaggaaatacagatgcccaagaaaaggaagagaggcagggaagagctcatcggtggagcagtcagaacacacacaatatttgtcgattaagtttgtcaacttctatgagtgcagttcctgttacccccagaataattacatacaacagggtgattatagtcaataataacttaattgtgcagtatgaaaactaaaagagtgtaaatggattgattgtaaccaaggataaatgtttgaggggatagatcccttattttccatgatgtgatttttacgcatttgcatgcctgtatcaaaacgtctcatgtatcccataagtatatacacctactgtgtacccacaaaaataaaaaacagaaattattttaaaagactaaaaaacaataaaaacaattgcagtaataatatcaaagctcactgatcacaaatcaccataacagatataataataatggaaaagtgtaaaattggtgagaatttccaaaaaaaaaattgcaacatctgtgaagcagtatgaaaatgaggtgcaataaaacaaggtacgcctgtgtggccttaataaatacgtgctgaatgaaaggaggtaagggtgaatgttcccgtaagtgaagaggttgggaatctaaacctgacaacggaaggagccagaagctaaaactttaatttgcatttggcctgtattggtgtgggtctaaggtctcagcctctctaagccagagaatgtgaaaaactggataaagaagacccatgggcacttggtggtggggaggcatctccttttttggagaaaacagagcctaacactctccaatcaacccaaccctctccaatctacccaaccctcatcttccaactcttctccatcataggacccaaaagggggaaacatgcctggacccacagagtgcgtgagagaaagcaactggtgatttatgaagagatcagcgaccctcaggaagatgacgagtaactccgtaagtgaacctttggctcatctcccacatccttgcagatgtgctattctgttatggtactggtatcccatcttatcagttgttccccaaatcattcccttctcataattttctagggtacagcattgaggctgaatgatgaaatttcccatgtttttttttgtgggtgggggagtctccttttgttcccccaggctggagtgcagtggcatgatctcggctcactgcaagctccgcctcccgtgttcacgccattctcctgcctcagcctccccagtagctggggctacaagcacccgccaccacgaccgggtaattttttttcttgtatttttagtagagacagggtttcgccatgtcagccagaatggtctcaatctcctgacctcgtgatccatctgcctccgcctcccaaagtgttgtgactacaggcgtgagcctctgcgcctgcctaaccatgctctttctactccctgccctctatatccagggatcctccctacccaggatgctgtgggttcccaaaccccaggtcagcactgatatgcgggccacaccttcctctagcctaggaattgataacccaggcgaggaagtcactgtggtatgagcagatggttcacttcaaggaaccatggaaggcgtgtacaggtcctgaggtagggcagaatcggagtgggcagggtctgcaggtcaggaggagttgagattgagttgtcatgtggtgggaactcactgccacttactttccttctcgcttcttgcctcagcctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgt

SEQ ID NO: 3375 - DNA, 5606 bp, human; identical to SEQ ID NO: 3371

SEQ ID NO: 3376 - DNA, 10543 bp, human; identical to SEQ ID NO: 3372

SEQ ID NO: 3377 - DNA, 10543 bp, human; identical to SEQ ID NO: 3372

SEQ ID NO: 3378 - DNA, 9138 bp, human; identical to SEQ ID NO: 3374

SEQ ID NO: 3379 - DNA, 9359 bp, human
ctttcgattcttccatactcagagtacgcacggtctgattttctctttcgattcttccaaaatcagagtaagcatgcgctgattttctttttccattcttcctacccctcccctcctccgcggtgcatttgttatctagttttaataaggagtgtatgtgaggcaggtcgccatctcaaatccttcctgtcagtttctaactttttcaggtatgggatttttcctgggaactctagtaacttaacaaatttgggccgggtacggtggctcacgcttgtaactccagttttggaggccacagctggtggatcacttgaacccacgaggcggaggttgcagtgagccatgatcacaccactgcatcccagcctgggcaacagagagagaccatgactcaaaacaaacaaacaaacaaacaaacaaaaaatctcactcaaatctttcctcctgggctcaagtgatcctctcacgtaggccttgggactacaggcgcacaccactccgcttctgttaatgtgtgtgtgtgtgtgtgtgtgtgtgtgtgtgttttgttgttgttgttgttttagtagagatggtttcggtatgttggccaggctggtctcaagctcatggactcaagcgacccgccctccttgtcctcccaaagtgctgggattacaggcatgagccactgcgcctggctgattgctgtaccttgaaactccctacattctctttaagtgatggcgggctcttgtagtctcagaaattctagctctcttcttctaataatttacaaatcacccagtaatagcctctaaatccgttcatattagccatgctcatttctcttcaacagaacagaaccccccatccctctgcctgatcagatccatcaccagagagaccatgttatctctgggactcatttcccttcctttatttattgagtgggggtgtcagcatgcccccactgaataaaattacacagtcacatctctgccttcccaacaagggtctgtacatctttcagggtaagcctggccccagggaaactactaacaacattagccaaccccctcccaaagactcaaggctgctttgcccacaggaagcctgtcatcccaaatcaatacttctcccagagacccctggttccctattttcatctgacttcgccccatgtcattactcagggacagataagccccagatggagaaatgaagcacctgattccaggtgactgagggtggccggccttcactgatttctccctccacaagaccaaagctgctgtggctggaaagactcggtctgtttctcttgcaggacagactgctcccggtgccatgaacggagacgatgcctttgcaaggagacctagggctggttctcaaataccagagaagatccaaaaggtgaggtgacctggagggggcaaagtagtggcccaggggacagtgtggggtgaccggtttctgaggaggggaggatagagatactggagacaaggagcagggtcttgggggagatctggacccttgagagcctcccatcctcgctctatcatcaactagcatccttggagacaagtctgtgaccgtgcactacatttggtgaatctcagtccattctggaaagtgggaagagagccagccagcagcattaaagccctactgtgtggcaggggtgaagctaggaaaggtccctcatgttctgtcagttagccatggcatcaaccaggacggaatatcatccccacttcccagatccagcacacaggaggcggctccagctgaatggcagacgtgtctagctgagtcactgacaaaattccttttttatcttttcctaggccttcgatgatattgccaaatacttctctaagaaagagtgggaaaagatgaaatcctcggagaaaatcatctatgtgtatatgaagagaaagtatgaggccatgactaaactaggtaacagaaagttctaggtacagacaagtctggggacacatgagcatcccttttcctgctttggctacttcttaggctgcagaaagtaccccacattttccttttgtgcagggaaaaatcgcaaggcagcttctgggtgttctgctcttctgtatcctgtcagggctgagggcagggactggccacagtggagctcatacctggatcctgcacgtttctctcccttaggcttctgttctgatgagtccaagtgtctctgtggcatcccggcacctccacaccgtccctaccttccttctctcggcttgtatctctctttctttttttttctttttttttgagtcagagtctcagtctgtcacctaggctagagtgcagtagtgcaatcatagctcactgcagccttgaactcctggcctcaagcaatactccagcctcagcctcccaaagcgctggtactacagatatgaaccaccgtggcaggtcaaagcttgtctcttaggaataaacattttgcttctttctaggtttcaaggctaccctcccacctttcatgtgtaatacaggggccacagacctccaggggaatgattttgataatgaccgtaaccacaggaatcagggtgagtagatgggaaggggctggaaagggtctcatcaagcccaattgcttttcagctcagttacctgggaaagatcctcaggcatttgttccctcatacacatcagggctgagtgaaaaaaaattgcatgcagaaagttaacgacagaggccattcatgtaacattttaaaacatgaaaaacaagtatatatatttttatagataataagtaaatggtaaatgtatacaaacatgaatgtgaataaaaagccatcaaattgaggtgactggctgtaagtggaggagggagggagggcagggattgctgagtgctgcacagacaggttcagctgtgacttgttgatagtgtgttttgtttgtttttgtttttgagatggagtttcactcttctcggccagggtggagtgcaataaggcaatctcagctcactccaactttcaactcccgggttcaagtgattctcctgcctcagcctccggagtagctggggttacagttgcccgcccccacacccagctcattttttatttttggtagagacggggttttaccatgttggccaggctggtctcaaacttcctgacctcaggtgatccacccacctcagcctcccaaagtgctgggattacaagtgtgagctaccacgcccggcctgtttgtagtttttctaatattctgaataaataaatcagacctaacatagctgtggggtaatgttgagatccgactggactcaatattattccccatacttttctgtgtgtttgaaatatttcttttttaaacgacatgttgttcttcctaagcactgttaatgaatcaaaggactgttaaaataatgttacaagagaaaaaaaaagaaagaaaatgttactagtgtagatctgccaaaaacttccagagtttgtttcattaacagcatgtaggtattggataggtatcttaggagtgaggttgatgaacacattatgtaataaagatcgctgtttctctgtattttatcaaaaccaaatagtcttctcattcccaaagaaccctgattctctgtgatgagctcgggagtgagtttgaaagagtgatccctcatcccacacacagagagctttcccacttgtcagagagcagagataacacagggtgaaaaaaagacaggttcttgggtagagatctttgtacatttcagtaatataaagggggcatatgtgtttccttgctcttctgctctgacaacacaattataagacaaggtcagaatgtccaaactatctccaatagacctattactccccaactaaaaaggccagattctacaatctcccacgatcactacaagagatctgaaaatccagggcttgagtgtctgccaagattttgacattaaagaagtgtctttatactgaaaatatttcagagccactggaccaaatcatccatggttcatcacacatttaacagcttaattcacataccgtaagattcacccattttaagtgtacagtgattttcagttattgcacatcttgagtggatacagttcagattcttaaccaatcaatttaattatttggaaaaaagtaaaagatatgtaaagtaataagatgagactgtgatggggtttagtccacatttgataaactatgagatggaaaattctgaatggatgccacagataaatgaatcaaccattactaaacataattcagaagcaaatctgaaataactcctcaacaatgagtggactcataagcctctgctggagaataccctgatgctacagaagtctctatagagtttggaaatctttaccaacaaggaaaaattctgatgtattctcttgcagttgaacgttctcagatgactttcggcaggctccagggaatcttcccgaaggtgagtatctctcaaatctaaaggaccagagaacctttgtccctccacagatgggaacactggtaagagtgggagaatataaaaaatgccctcactgccttcttctccccatatctatcacaacacctgatgtagcaccaacagcttgataacactaacagttgtgatcctcaatacatcttttgttttcatagtgatgccagatactattttaagcagttcacatggatgaatttatttaatccttaagaagacctctatgatgttgtttctattattatctccaaataataacgagtcacacacttcggttgtcatccatataaaagccatgtgacttggcacaaatcttctgagttctctgagctccagattcctggtccatgaaatggaagtaaagaatcatagttcatgttttagatcatagttatcagcaacataataataaaatgaggctatcattgtacagagatgttaaagaattttcctggggcacagtgtcagtggtagtctaatccagagctccaagccatttaaagctcattcacgtttgcatttgtttatgaagttcagatgttgctcactagggctttaccccatagggcctcctggtgcttccattgagacacccgctctcgcaacaggaaggaccagctggcctctgctctgttactgggaccacttgcatggcttaggaatcgctttgactgttggcccctccctactgtgagctccttgaggaccttgtctgcacctggggcgtcccggaagcccccattccagcccaggggttccctcaaagacccctgaatgagtcatcccacaactgcagatccaactctggtttagaggataaagggatctgggagttgggttgccagtgtggagaccgaattcaaagatggatcatgaaaggtattaattgttattattactacatttaaacagtgtttacaagctcagagaggactttcccatagactattttatgtgtattgttcactatttcataagtgaggaagctgaataaaaagtagattaagagcggggcacggtggctcgcgactgtaatctcagcactttgggaggctggggtggatggatcactaggtcaagagatcaacaccatcctgcccaacatggtgaaacctcgtctctactaaaaatacaaaacttagcggggcgtggtagaacctgcctgtagtcccagctactctggaggctgaggaaggagaatcacttgaacgcaggagttggatgttgcagtgagccaagatggcgccagtgcactccagcctggcaagagagcaagactgtgtctcaaaaaaaaaaaaaaaaaaagtagcttaagattgttggtcagtgacacgtcccaatgcaaccagaattggtatgggtaccacctcactgaattccacattcaattggtgcctctgctttctttgctgcctagattaatttcagcaaaccatttctttacctctcctgtccctgtattcatctccccacaacatctttcccagcagtgttttgtcccctctctatgtttttacatttactctcccagcagctaagagctaatatgagatcccttgtattttacagaagctcttccttttgtagaccttatgaattcttagaatgctatcctccttccaatcttttgtataccaaactctcaattacatggagatttttgctgtttgcaagaatgtcagtcttaaaagagtgtgaagataagcattctagccctggaaaccatattcacataggccattcctttcccatctaacctcccaggtttctcctaatttaggcaagtgtaactctcccagcattgttgagaacattgattaaagtaatgcatgtgaagaccctttgtaagctctaaagcactgtagaaatgtcaccgatactgtttatctgtgaccttcacattataaagatcatgcccaagaagccagcagaggtaggaaatgattcgaaggaagtgccagaagcatctggcttacagaacgatgggaaacagctgtgccccccgggaaaaccaactacctctgagaagattaacaaggcatctgggaagaggaaataatttgggaacaacccctctggcttccctggctatgttcaggtgtgtggactgggtgtgtggcatggatcccagacaagcctgggtgcagactgggctgaggagctcacccagctccagatgagatgtttgactggacttccagagatacagactggagttgtcatccatataaaaaaacacgtgacttggggcaagtcttccaaattttctcagttccagattcctagtccataagatggaaataaagaatcatagttcataaattgtttggaagtattatatttaatctagaaggcctgatgatatgaaaggtgctcaagcgattctatctttgataacctgggatcatatcttacttagctcaatgcctgatacccagtacaggtgtacttcagagatattgcagattcagtcccagaccactgcaataatgtgagtcacacacattgtttttttggtttggcagtgcataaaaacattatgtttacactatactgcagtctactaggagtgcagtagcgttatgtctaaaaatgtacatacctttattttaaaataattcattgttaaaaatgctaataatcttctgagtcttcagtgactcactctttttgctggtggagggtcttgcctcggtgttgatggctgttggctgatcaaggtggtggttgctgaaggttggagtggctgtggcagtttcttaaaagaacacaacagtgaaatttgccacatcgattagctctccatttcatgaaggatttctctgtagtgtgtgatgctattggatagcattttacccacagtagaattctttcaaagttcgagtcaattctctctagctatgaaagtcctagaaggcatctccttccgatagaaggctattttatctacattgaaaatctgttgcttggtgtagccaccttcaacagtgatcttagctagatcttctggataacttgctgcagcttctccatcggggtttcctgcttcgccttgcacttttaagttatggagatggcttctttccttaaacctcatgaaccaacctctgctagcttcacacgtttctcctgcagcttcttcacctctctcagctttcatggactggaagagagttcgggtctctctgtgaattagactttggcttaagggaatgttgtggctggtttcgtcaaatatcctgaccgctcaaactttctctatttgagcagtaaggcagttttgctttcttattcgtgtgttcactggagtgttaatattattatttccttcaaggactttccctttgcattatatactattatttccttcaagaacttttcctttgcattcacagcttggctgtttggtgcaagaggccgagctttcagcctgtcttggctttcagcatgcttcctcactaagcttagccatttctagcttgtgatttagagtgagaggcatgcgactcttcctttcatttgaacacttaacggccattgtaaggttgttaataatcctcatttcagtgttgctgtgtctcaggaaatagggaggcccaagaaaaggaggagagacgtggaacagctcatcggtggagcagtcaggacacacacaacattggtcgattaagtttgtcaacttctatgggtgcagttcatggtacccaccccccaaacaattacacagaacagggtgattattgtcaataataattgtacatttttaaaaaactagaagagtgtaattggattgtttgtaacacaaggataaatggttgaggggatggataccctattttccatgatgtgattattacgcatagcatgcgtgtatcaaaacatctcacgtaccccataagcacatacacctactgtgtacgcacaaaaataaaacacacggacgggcaatgtggctcacgcctgtaatcccagcactttgggaggctgaagcaggccgatcgtgaagttgggagatcgagaccatcctggctaatacagtgaaaccctgtctctactaaaaatagaaaatattagccaggcgtggtgacatgctcctgtagtcccagctacttgggaggctgaggcaggagaattgcttgaactggagaggcagaggttgcagtgagctgagattgctccactgcactccagtctgggtgacagagcgagacttcgtctcaaataaaataaaataaaataaaaattaaaaatttaaaacttaaaattattttaaaagcctgaaaaacaacaaaaacaattgcagtaataatatcaaagctcactgatcacagatcactataacagatataataataatggaaaagtgtaaaattgatgagagtttccaaaaaaaacattgcagcatctgtgaagcactatgaaaatgttgtgcgataaaaaaaagtatgcctcggtgccctcaataaaaacacgtgctgaatgaaaggaggtaagggtggatgttcccgtaagtgaagaggttgggaatctaaaccccacaacagaagcagccagaagctaaaactttaattggcatttggcctgtattggtgtgggtctaaggtctcagcctctctaagccagagaatgtgaaaaactggataaagaaggcccatgggcacttgggaggggggaggcatctcctttttttgagaaaacagagcctaacactctccaacctacccaaccctcactttccaactattctccatcacaggacccaaaagggggaaacatgcctggacccacagactgcgtgagagaaagcagctggtgatttatgaagagatcagcgaccctgaagaagacgacgagta

SEQ ID NO: 3380 - DNA, 10790 bp, human
aaagcatcccccgggattggctactttaagttcagagtatgcatgctctgactttctctctctttcgattcttccatactcagagtacgcacggtctgattttctctttcgattcttccaaaatcagagtaagcatgcgctgattttctttttccattcttcctacccctcccctcctccgcggtgcatttgttatctagttttaataaggagtgtatgtgaggcaggtcgccatctcaaatccttcctgtcagtttctaactttttcaggtatgggatttttcctgggaactctagtaacttaacaaatttgggccgggtacggtggctcacgcttgtaactccagttttggaggccacagctggtggatcacttgaacccacgaggcggaggttgcagtgagccatgatcacaccactgcatcccagcctgggcaacagagagagaccatgactcaaaacaaacaaacaaacaaacaaacaaaaaatctcactcaaatctttcctcctgggctcaagtgatcctctcacgtaggccttgggactacaggcgcacaccactccgcttctgttaatgtgtgtgtgtgtgtgtgtgtgtgtgtgtgtgttttgttgttgttgttgttttagtagagatggtttcggtatgttggccaggctggtctcaagctcatggactcaagcgacccgccctccttgtcctcccaaagtgctgggattacaggcatgagccactgcgcctggctgattgctgtaccttgaaactccctacattctctttaagtgatggcgggctcttgtagtctcagaaattctagctctcttcttctaataatttacaaatcacccagtaatagcctctaaatccgttcatattagccatgctcatttctcttcaacagaacagaaccccccatccctctgcctgatcagatccatcaccagagagaccatgttatctctgggactcatttcccttcctttatttattgagtgggggtgtcagcatgcccccactgaataaaattacacagtcacatctctgccttcccaacaagggtctgtacatctttcagggtaagcctggccccagggaaactactaacaacattagccaaccccctcccaaagactcaaggctgctttgcccacaggaagcctgtcatcccaaatcaatacttctcccagagacccctggttccctattttcatctgacttcgccccatgtcattactcagggacagataagccccagatggagaaatgaagcacctgattccaggtgactgagggtggccggccttcactgatttctccctccacaagaccaaagctgctgtggctggaaagactcggtctgtttctcttgcaggacagactgctcccggtgccatgaacggagacgatgcctttgcaaggagacctagggctggttctcaaataccagagaagatccaaaaggtgaggtgacctggagggggcaaagtagtggcccaggggacagtgtggggtgaccggtttctgaggaggggaggatagagatactggagacaaggagcagggtcttgggggagatctggacccttgagagcctcccatcctcgctctatcatcaactagcatccttggagacaagtctgtgaccgtgcactacatttggtgaatctcagtccattctggaaagtgggaagagagccagccagcagcattaaagccctactgtgtggcaggggtgaagctaggaaaggtccctcatgttctgtcagttagccatggcatcaaccaggacggaatatcatccccacttcccagatccagcacacaggaggcggctccagctgaatggcagacgtgtctagctgagtcactgacaaaattccttttttatcttttcctaggccttcgatgatattgccaaatacttctctaagaaagagtgggaaaagatgaaatcctcggagaaaatcatctatgtgtatatgaagagaaagtatgaggccatgactaaactaggtaacagaaagttctaggtacagacaagtctggggacacatgagcatcccttttcctgctttggctacttcttaggctgcagaaagtaccccacattttccttttgtgcagggaaaaatcgcaaggcagcttctgggtgttctgctcttctgtatcctgtcagggctgagggcagggactggccacagtggagctcatacctggatcctgcacgtttctctcccttaggcttctgttctgatgagtccaagtgtctctgtggcatcccggcacctccacaccgtccctaccttccttctctcggcttgtatctctctttctttttttttctttttttttgagtcagagtctcagtctgtcacctaggctagagtgcagtagtgcaatcatagctcactgcagccttgaactcctggcctcaagcaatactccagcctcagcctcccaaagcgctggtactacagatatgaaccaccgtggcaggtcaaagcttgtctcttaggaataaacattttgcttctttctaggtttcaaggctaccctcccacctttcatgtgtaatacaggggccacagacctccaggggaatgattttgataatgaccgtaaccacaggaatcagggtgagtagatgggaaggggctggaaagggtctcatcaagcccaattgcttttcagctcagttacctgggaaagatcctcaggcatttgttccctcatacacatcagggctgagtgaaaaaaaattgcatgcagaaagttaacgacagaggccattcatgtaacattttaaaacatgaaaaacaagtatatatatttttatagataataagtaaatggtaaatgtatacaaacatgaatgtgaataaaaagccatcaaattgaggtgactggctgtaagtggaggagggagggagggcagggattgctgagtgctgcacagacaggttcagctgtgacttgttgatagtgtgttttgtttgtttttgtttttgagatggagtttcactcttctcggccagggtggagtgcaataaggcaatctcagctcactccaactttcaactcccgggttcaagtgattctcctgcctcagcctccggagtagctggggttacagttgcccgcccccacacccagctcattttttatttttggtagagacggggttttaccatgttggccaggctggtctcaaacttcctgacctcaggtgatccacccacctcagcctcccaaagtgctgggattacaagtgtgagctaccacgcccggcctgtttgtagtttttctaatattctgaataaataaatcagacctaacatagctgtggggtaatgttgagatccgactggactcaatattattccccatacttttctgtgtgtttgaaatatttcttttttaaacgacatgttgttcttcctaagcactgttaatgaatcaaaggactgttaaaataatgttacaagagaaaaaaaaagaaagaaaatgttactagtgtagatctgccaaaaacttccagagtttgtttcattaacagcatgtaggtattggataggtatcttaggagtgaggttgatgaacacattatgtaataaagatcgctgtttctctgtattttatcaaaaccaaatagtcttctcattcccaaagaaccctgattctctgtgatgagctcgggagtgagtttgaaagagtgatccctcatcccacacacagagagctttcccacttgtcagagagcagagataacacagggtgaaaaaaagacaggttcttgggtagagatctttgtacatttcagtaatataaagggggcatatgtgtttccttgctcttctgctctgacaacacaattataagacaaggtcagaatgtccaaactatctccaatagacctattactccccaactaaaaaggccagattctacaatctcccacgatcactacaagagatctgaaaatccagggcttgagtgtctgccaagattttgacattaaagaagtgtctttatactgaaaatatttcagagccactggaccaaatcatccatggttcatcacacatttaacagcttaattcacataccgtaagattcacccattttaagtgtacagtgattttcagttattgcacatcttgagtggatacagttcagattcttaaccaatcaatttaattatttggaaaaaagtaaaagatatgtaaagtaataagatgagactgtgatggggtttagtccacatttgataaactatgagatggaaaattctgaatggatgccacagataaatgaatcaaccattactaaacataattcagaagcaaatctgaaataactcctcaacaatgagtggactcataagcctctgctggagaataccctgatgctacagaagtctctatagagtttggaaatctttaccaacaaggaaaaattctgatgtattctcttgcagttgaacgttctcagatgactttcggcaggctccagggaatcttcccgaaggtgagtatctctcaaatctaaaggaccagagaacctttgtccctccacagatgggaacactggtaagagtgggagaatataaaaaatgccctcactgccttcttctccccatatctatcacaacacctgatgtagcaccaacagcttgataacactaacagttgtgatcctcaatacatcttttgttttcatagtgatgccagatactattttaagcagttcacatggatgaatttatttaatccttaagaagacctctatgatgttgtttctattattatctccaaataataacgagtcacacacttcggttgtcatccatataaaagccatgtgacttggcacaaatcttctgagttctctgagctccagattcctggtccatgaaatggaagtaaagaatcatagttcatgttttagatcatagttatcagcaacataataataaaatgaggctatcattgtacagagatgttaaagaattttcctggggcacagtgtcagtggtagtctaatccagagctccaagccatttaaagctcattcacgtttgcatttgtttatgaagttcagatgttgctcactagggctttaccccatagggcctcctggtgcttccattgagacacccgctctcgcaacaggaaggaccagctggcctctgctctgttactgggaccacttgcatggcttaggaatcgctttgactgttggcccctccctactgtgagctccttgaggaccttgtctgcacctggggcgtcccggaagcccccattccagcccaggggttccctcaaagacccctgaatgagtcatcccacaactgcagatccaactctggtttagaggataaagggatctgggagttgggttgccagtgtggagaccgaattcaaagatggatcatgaaaggtattaattgttattattactacatttaaacagtgtttacaagctcagagaggactttcccatagactattttatgtgtattgttcactatttcataagtgaggaagctgaataaaaagtagattaagagcggggcacggtggctcgcgactgtaatctcagcactttgggaggctggggtggatggatcactaggtcaagagatcaacaccatcctgcccaacatggtgaaacctcgtctctactaaaaatacaaaacttagcggggcgtggtagaacctgcctgtagtcccagctactctggaggctgaggaaggagaatcacttgaacgcaggagttggatgttgcagtgagccaagatggcgccagtgcactccagcctggcaagagagcaagactgtgtctcaaaaaaaaaaaaaaaaaaagtagcttaagattgttggtcagtgacacgtcccaatgcaaccagaattggtatgggtaccacctcactgaattccacattcaattggtgcctctgctttctttgctgcctagattaatttcagcaaaccatttctttacctctcctgtccctgtattcatctccccacaacatctttcccagcagtgttttgtcccctctctatgtttttacatttactctcccagcagctaagagctaatatgagatcccttgtattttacagaagctcttccttttgtagaccttatgaattcttagaatgctatcctccttccaatcttttgtataccaaactctcaattacatggagatttttgctgtttgcaagaatgtcagtcttaaaagagtgtgaagataagcattctagccctggaaaccatattcacataggccattcctttcccatctaacctcccaggtttctcctaatttaggcaagtgtaactctcccagcattgttgagaacattgattaaagtaatgcatgtgaagaccctttgtaagctctaaagcactgtagaaatgtcaccgatactgtttatctgtgaccttcacattataaagatcatgcccaagaagccagcagaggtaggaaatgattcgaaggaagtgccagaagcatctggcttacagaacgatgggaaacagctgtgccccccgggaaaaccaactacctctgagaagattaacaaggcatctgggaagaggaaataatttgggaacaacccctctggcttccctggctatgttcaggtgtgtggactgggtgtgtggcatggatcccagacaagcctgggtgcagactgggctgaggagctcacccagctccagatgagatgtttgactggacttccagagatacagactggagttgtcatccatataaaaaaacacgtgacttggggcaagtcttccaaattttctcagttccagattcctagtccataagatggaaataaagaatcatagttcataaattgtttggaagtattatatttaatctagaaggcctgatgatatgaaaggtgctcaagcgattctatctttgataacctgggatcatatcttacttagctcaatgcctgatacccagtacaggtgtacttcagagatattgcagattcagtcccagaccactgcaataatgtgagtcacacacattgtttttttggtttggcagtgcataaaaacattatgtttacactatactgcagtctactaggagtgcagtagcgttatgtctaaaaatgtacatacctttattttaaaataattcattgttaaaaatgctaataatcttctgagtcttcagtgactcactctttttgctggtggagggtcttgcctcggtgttgatggctgttggctgatcaaggtggtggttgctgaaggttggagtggctgtggcagtttcttaaaagaacacaacagtgaaatttgccacatcgattagctctccatttcatgaaggatttctctgtagtgtgtgatgctattggatagcattttacccacagtagaattctttcaaagttcgagtcaattctctctagctatgaaagtcctagaaggcatctccttccgatagaaggctattttatctacattgaaaatctgttgcttggtgtagccaccttcaacagtgatcttagctagatcttctggataacttgctgcagcttctccatcggggtttcctgcttcgccttgcacttttaagttatggagatggcttctttccttaaacctcatgaaccaacctctgctagcttcacacgtttctcctgcagcttcttcacctctctcagctttcatggactggaagagagttcgggtctctctgtgaattagactttggcttaagggaatgttgtggctggtttcgtcaaatatcctgaccgctcaaactttctctatttgagcagtaaggcagttttgctttcttattcgtgtgttcactggagtgttaatattattatttccttcaaggactttccctttgcattatatactattatttccttcaagaacttttcctttgcattcacagcttggctgtttggtgcaagaggccgagctttcagcctgtcttggctttcagcatgcttcctcactaagcttagccatttctagcttgtgatttagagtgagaggcatgcgactcttcctttcatttgaacacttaacggccattgtaaggttgttaataatcctcatttcagtgttgctgtgtctcaggaaatagggaggcccaagaaaaggaggagagacgtggaacagctcatcggtggagcagtcaggacacacacaacattggtcgattaagtttgtcaacttctatgggtgcagttcatggtacccaccccccaaacaattacacagaacagggtgattattgtcaataataattgtacatttttaaaaaactagaagagtgtaattggattgtttgtaacacaaggataaatggttgaggggatggataccctattttccatgatgtgattattacgcatagcatgcgtgtatcaaaacatctcacgtaccccataagcacatacacctactgtgtacgcacaaaaataaaacacacggacgggcaatgtggctcacgcctgtaatcccagcactttgggaggctgaagcaggccgatcgtgaagttgggagatcgagaccatcctggctaatacagtgaaaccctgtctctactaaaaatagaaaatattagccaggcgtggtgacatgctcctgtagtcccagctacttgggaggctgaggcaggagaattgcttgaactggagaggcagaggttgcagtgagctgagattgctccactgcactccagtctgggtgacagagcgagacttcgtctcaaataaaataaaataaaataaaaattaaaaatttaaaacttaaaattattttaaaagcctgaaaaacaacaaaaacaattgcagtaataatatcaaagctcactgatcacagatcactataacagatataataataatggaaaagtgtaaaattgatgagagtttccaaaaaaaacattgcagcatctgtgaagcactatgaaaatgttgtgcgataaaaaaaagtatgcctcggtgccctcaataaaaacacgtgctgaatgaaaggaggtaagggtggatgttcccgtaagtgaagaggttgggaatctaaaccccacaacagaagcagccagaagctaaaactttaattggcatttggcctgtattggtgtgggtctaaggtctcagcctctctaagccagagaatgtgaaaaactggataaagaaggcccatgggcacttgggaggggggaggcatctcctttttttgagaaaacagagcctaacactctccaacctacccaaccctcactttccaactattctccatcacaggacccaaaagggggaaacatgcctggacccacagactgcgtgagagaaagcagctggtgatttatgaagagatcagcgaccctgaagaagacgacgagtaactccgtaagtgaaccttcggctcatcccccacatccctgcagatgtggtattctgttatggtactggtatcccatctgtcacttgttccccaaatcattcccttctcataattttctagggtacagcattgaggccgaatgatgagagatttcccacgttttttttttttttttttgacggattctccctttgtggcccaggctgcagtacagcagcatgatctccgcttactgcaagctccgcctcacgggttcatgccattctcctgcctcagcctctccagtagctgggactacaagcgcccgccaccacgcccgggtaattttttttgtgtttttggtagagacggggtttcaccgtgttagccaggatggtctcggtctcctgaccttgtgatccacccgcctcggcctcccaaagttctgggattacaggcgtgagccaccgcgcctggtcttcgcaagctctttttactccctgccctgtatatccagggatgctccctacccaggatgctgtgtgtttccaaactccaggtcagccctgtatgtgggccacaccttcctctagcctaggaatggataacccaggcgaagaagtcactgtggcatgagcagatggttcacttcgaggaaccgtggaaggcgtgtacaggtcctgaggtaggacagaatcagagtgtgcaaggtctgcaggtcaggaggagttgagattgagttgtcacgtggtgggaactcactgccacttactttccttctctcttcttgcctcagcctcggggatacgacacatgcccatgatgagaagcagaatgtggtgacctttcacgaacgtgggcatggctgcggacccctcgtcatcaggtgcatagcaagtgaaagcaagtgttcacaacagtgaaaagttgagcttcattttttagtgtgccaagagttcgatgttagtgtttccgttgtattttcttatagtgtgcaattctgttagatattaatgttttcattgatgagcaagacatgcttaatgtgtatttcggtttgtgtatccatgcacctacctcagaaaacaagtatagtcaggtattctctccatagaacagcactaccttcctctctccccacatgtgactactgagggcagttctgagtgtttaatttccgattttctcctctgcatttacacacacacacacacacacacacagagacacacacacacaccaagtaccagtataagcatctcccatctgcttttccccattgccatgcgtcctggtcaagcccccctcactctgtttcctgttcagcatgtactcccctcctctgattccccgtatcagtcactgacagttaatacacctttgcaaacgtt

SEQ ID NO: 3381 - DNA, 3836 bp, human
gaaaagggtcaatcaagtcttcccactaagagcaaggacacccacatctgtggccagtgctgtgccaagttctttgaattatcacatcttctgctccacaagaagaactgtactaaaaatcaattagttttatttgtaaatgaaaatccagcctccccatccaaaaccttctcccccaggctccctcccaataatcctgatgaacaaatgaatgaaacagttaacaaaacagatcaagtggactgcagcgacctttcagaacacaacagacttgacagggaagagtccatggaggtggaggccccagtagctaacaaaagtggcagcagcacttccagccacagccacagcagtattgccccaagtggcagcagcagcagcagctcccccacagatacctcagtgatcacaacctctctacctcaactcggggacctgacaacactgggcaacttctccgtgatcaacagcaacgtcatcatcgagaacctccagagcaccaaggtggtggtgtcccagttctcccaggaagtgaggtgccgtggggcttcctggggcaagttggccatcccagccctcatggaacagctcctaggtatgcagcagcagcaggtccactagctgcaactgatcgaatagatttgtcaccaaatattgctgttggcttctcagaatgcagacttgccaacatcttctcatccttctcaaggtactttacaaacatctgccaaccccttgtccatgctaaattcccatttatctcagcagctggcagcagcagcttgattgtcacagagcctcgccagccaatctgctagcattagtggtgtgaaacagctaccccaatccagctacttcagagtagttctggcaacaccatcattccatccaacagtggcttttctcccaatatgaacatattggtggtgtcagttaccaccccgtcctcagaaaaggtggcttcaagagctgcggcctcccatgtcagcaacccagctgtctcatcatcatcctcaccagcttttgcaataagcagtttattaagtcctgcatctgatccacttctacatcagttggcccccgctaactcagttttccccagccctttgcccaacattggaacaactgcaggggatttagactccttgtctgccttggcccagcaaagaaaaagcaagccaccaaatgtcactgcctttgaagtgaaaaatacttccaatgaggcattcttcaaacgcaagtgcaggttctgcacaaaggtctttgagagcgacagtgccttgcagatccacttgcattcccatactggaaagagggcgttcaagtacaacatctgtgggaacgggttctccaccaagaagaatctgaaagtccactttcagtgccacaaagagaaatacacccatacccagatgaacccttatcctgtgcctgagcatttggacaatatccccatgagtactggcatcccatatggcatgtccatcactccagagaagccggtcaccagctggttagacaccaaaccagtcctggctactctgaccacttcagtctgcctgccattgctcccaaccctcccaagcctcatactcttcatcaagacggaagagccagcccccttccccattagccattctgccaccagtcccacaggtttagtcaaaagtgactccagggccgccgagctggccacaagaaacctaggtgggctcccagaggaagctgaagggtccactctgccaccctccagtggcaaaagcaaagagagtggtgtggtcaccaactcggtcctgacagcgaacagtagtgccctgagctccccagcagcagactggggccccctggggaagcactaccaccttcaccaaccctttgttgcctctcatgtccaagcagttcaaggccaagtttccttctggggggctcttggactcagcccaggcatcagagacatccaagcttcagcaactggtagaaaacattgacaaaaggccactggccccagtgagtgcatcatctgctacccagttctcagctgtcagagtgccttgtaaatgcactattggacacacattagggagaggccttttaagtgtaagatctgtggccaggttttcatcacagaaaggaatcttaaaacccactacagtgtccatcatgctgtgcccctgctcagagcccagcattcctgccccatctgctggaagttgacagacgatgctgtcatcccgcagcagcacactcgaatgcatatgggaggccaggtctccaacactccagtccccagcagttactctgagtccatggagtctgacataggctccttctatgggaaaaattttgatgacctagacaacttctccagtgaaaaaatggaagactgtcctgagggcagattccctgatatgcccaagtctgcagacgactcccaagacagtttatcttcttcgcctttgcccctagagatgtcgagcatcactgctttggaaaatcagatgaagatgatgaatgttggcctagtggagcagctgcgggccagcctgaagtcagtggagaatgggtccttcgaggatgatgtcctgatcaatgattcatcctcagtgggtgatgacatggagagctaaagtgctggcagcccagccatctcagagtctacgtcttccatgcaggctctgtccccatccaacagcacccaggagttccataagtcacccagagaataggagaaaccacagagagtggtcccaagcgagtttgccaacggtttgtctttcattccagtgaatggcggggctttggatctgacatccagtcacatacagaaaatcatcagagaagattctctggggaccctcttccctttcagagtccagcgtaaatttaaaaacaccgcttgcaacatttgtggcaaaacatttgcttgtcagagtgccttggacattcactatagaaaccataccaaagagagaccatttatttgcagtttgcaattgtgacttttccacaaagggtaatttgaagcagcacatgttgatacatcagatgcaagatctaccatcacagctctttcagcccagttccaatcttggccccaatcagaactctgtggtgattcccgccaactcgttgtcatctctcagcaaaacggagatcaacggctttgtgcatatttctcctcaggacagtaaggacaccccaccagtcacatcccttctgggcctctgtctttctctgccacatctccagttctgctcttggctctgcccagaactcccaagcagcactactgcaacacatgtggcaaaacctccccctcgttgagtgcctggcagaactcacattggagagaaactgtttgcttgtactatttgtggaagagctttcacgacaaaaggtacacacgggcactcacatgtggaatagcacccctgtgtgacagggtaggcagctctctggggatgggcccatgacatttctaggaggcaatcccatcaagttcccagaaatgttccataaggatttggtggcaagatcaggaagtggggatccttccagcttctggaatcagaatgcagcacggcattccaacgggttggcgatgaagggcaacgggacctccgtcattcagaatggtggcatccatccaattcctggaagcctcgacactgggaacagctcacctgttagtgggctgacaggaaatctggagaagctccagaaatcagagcccactgcttctctggccggcctggggaaaatggcaagcaattagaagagaaccaattccgcttcacccgcttcatggaggacagcaaagagatcgtcacaagtta

SEQ ID NO: 3382 - DNA, 3283 bp, human
tgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaag

SEQ ID NO: 3383 - DNA, 4713 bp, human
gacactgctgaggtctaaacaaggaggcagaagtaggtaggtgccacttctcttcccttcattcttcgccaggctctctgctgactcaagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 3384 - DNA, 4670 bp, human
ccacttctcttcccttcattcttcgccaggctctctgctgactcaagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 3385 - DNA, 1983 bp, human
agtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagc

SEQ ID NO: 3386 - DNA, 485 bp, human
ctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccat

SEQ ID NO: 3387 - DNA, 7356 bp, human
cggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3388 - DNA, 2238 bp, human
gctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaag

SEQ ID NO: 3389 - DNA, 7445 bp, human
catgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3390 - DNA, 1142 bp, human
ttcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctc

SEQ ID NO: 3391 - DNA, 7381 bp, human
gtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3392 - DNA, 7392 bp, human
tccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3393 - DNA, 7421 bp, human
ggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3394 - DNA, 4635 bp, human
tgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 3395 - DNA, 7356 bp, human; identical to SEQ ID NO: 3387

SEQ ID NO: 3396 - DNA, 7356 bp, human; identical to SEQ ID NO: 3387

SEQ ID NO: 3397 - DNA, 4935 bp, human
ctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 3398 - DNA, 4980 bp, human
gggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 3399 - DNA, 5136 bp, human
ggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 3400 - DNA, 2948 bp, human
ggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 3401 - DNA, 5144 bp, human
gttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaa

SEQ ID NO: 3402 - DNA, 10810 bp, human
ccaggctccagggacagaaccttctcaaagtgggggtggagactctgattttcccgcctaaagcatcccctgggattggctactttaagttcagagtatgcatgctctgactttctctctcgattcttccatactcagagtacgcacggtctgattttctcttttgattcttccaaaatcagagtaagcatgcgctgattttctttttccattcttactacccctcccctcctctgtggtgcatttgttatctagttttaataaggagtgtatgtgaggcaggtcgccatctcaaatccttcctgtcagtttctaactttttcaggtatgggatttttcctgggaactctagtaacttaacaaatttgggccgggtacggtggctcacgcttgtaattccagcagttttggaggccacagctggtggatcacttgaacccaggaggcggaggttgcagtgagccatgatcacaccactgcatcccagcctgggcagcagagagagaccatgactcaaaaaaaaaaaaaaaaaaaaactcactcaaatctttcctcctgggatcaagtgatcctctcgcgtaggccttgggactagaggtgcacaccactccgcttctgttaatgtgtgtgtgtgtgtgtgtgttttgttgttgttgttgttttagtagagatggtttcggtatgttggccaggctggtctcaagctcatgggctcaagcgatccgccctccttggcctcccaaagtgctgggattacaggcgtgagccactgcgcctggctgattgctgcaccttgaaactccctacattctctctaagtgatggcgggctcttgtagtctcagaaattctagctctcttcttctaataatttacaaatcacccagtaatagcctctaaatccgttcatattagccatgctcatttctcttcaacagaacagaaccccctatccctctgcctgatcagatccatcaccagagagacgatgttatctctgggactcatttcccttccattatttattgagtcggggtgtcagcatgcccccactgaataaaattacacagtcacatctctgccttcccaacaagggtctgtacatctttcagagtaaggctagccccagggaaactactaacaacattagccaaccccctcccaaagactcaaggctgctttgcccacaggaagcctgtcatcccaaatcaatacttctcccagagacccctggttccctattttcatctgacttcgccccatgtcattactcagggacagataagccccagatggagaaatgaagcacctgattccaggtgactgagggtggccggccttcactgatttctccctccacaagaccaaagctgctgtggctggaaagactcaggctatttctcttgcaggtcagactgctcctggtgccatgaacggagacgacgcctttgcaaggagacctagggctggtgctcaaataccagagaagatccaaaaggtgaggtgacctggagggagcagagtagtggcccaggggacagtgtggggtggccaagtttctgaggaggggaggacagagatactggagacaaggaccagggtcttgggggagatctggatccttgagagcctcccatcctcgctctgtcatcaactagcatccttggagacaagtctgtgaccgtgcactacatttggtgaatctcagtccattctggaaagtgggaagagagtcagtcagcagcattaaagccctactgtgtggcaggggtgaagctaggaaaggtcgctcatgttgtcggttagccatggcatcatccccacttcccagatccagcacacaggaaggggctccagctgaatggcagacatgtctagctgagtcactgacaaaattccttttttatcttttcctagtccttcgatgatattgccaaatacttctctaagaaagagtgggaaaagatgaaatccttggagaaaatcagctatgtgtatatgaagagaaagtatgaggccatgactaaactaggtaacagaaagttctaggtacagacaagtctggggacacatgagcatccctattcctgctttggctacttcttaggctgcagaaagtaccccacattttccttttgtgcagggaaaaatcgcaaggcagcttctgggtgttctcctcttctgtatcctgtcagggctgagggcagggactggccacagtggagctcatacctggatcctgcacgtttctctcccttaggcttctgttctgatgagtccaagtgtctctgtggcatcccggcacccccacaccgtccctaccttccttctctcggcttgtatctttctttctttctttttttttgagtctgagtctcagtctgtcacctaggctagtttgcagtagtgcagtcatagctcactgcagccttgaactcctggcctcaagcaatactccagcctcagcctcccaaagcactggtactacagatatgagccaccgtgacaggtcaaagcttgtctcttaaggaataaacattttgcttctttctaggcttcaaggccaccctcccacctttcatgcataatacaggggccacagacctccaggggaatgattttgataatgaccgtaaccaagggaatcagggtgagtagacgggaaggggctggaaagggtctcctcaagcccagctgcttttcagctcagctacttgggaaagatcctcaggcatttgttccctcatacacatcagggctgagtgaaaaaaaaaaaaattgcatgcagaaagttaactacagaggccattcatataaaattttaaaacacgaaaaacaagaatatatatttttatagataataagtaaatggtaaatgtatacaaacatgaatgtgaataaaaagccatcaaattgaggtgactggctgtaagtggaggagggagggcgggcagggattgctgagtgctgcacagacagcttcagctgtgacttgttgatagtgtgttttgtttgtttttgtttttgagatggagtttcactcttctcggccagggtagagtgcaataaggcaatctcagctcactccaactttcacctcctgggttcaagtgattctcctgcctcagcctccggagtagctggggttacgggtgcccgcccccacacccagctcattttttatttttggtagagacggggttttaccatgttgaccaggctggtctcaaacttcctgacctcaggtgatccacctgcctcagcctcccaaagtgctgggattacaagtgtgagctaccatgcccggcctgtttgtagtttttctaatattgtgaataaataaatcaaacctagcatagctgtggggtaatgttgagatccgactggactcaatattattcctcatacttttctgtgtgtttgaaatatttcttttttagatgacatgttgttcttcctaagcaccattaatgaatcaaaggactgctaaaaaaatgttacaagagaaaaaaagaagaaagaaaatgttacaactgtagattcgccaaaaacttccagagtttgtctcattaacagcatgtaggtattggataggtatcttaggagtgaggatgatgaacacattatgtaataaagatcgctgtttctctgtattttatcagagccaaatagtcttttcattcccaaagaaccctgattctccgtgatgagcttggaagagagtttgaaagagtgatccctcatccaacacacagagagagctttcccacttgccagagagcagagataacatagggtgaaaaaaagacaggttcttcggtagagatctttgtacgttttgggaatataaaggggtcacatatgtgtttccttgctcttctgctctgacaacacaattataagacaaggtcagaacgtccaaactgtctccaatagacctattactccccaactaaaaaggccagattctaaaatctcccacgatcactgtaagagatctgaaaatccagtgcttgggtgtctgccaagattttgacattaaaggactgtctttatactgaaaatatctcagagccactggactaaatcatccatggttcatcacacatttaacagcttaattcacataccataagattcacccatttgaagtgtgcaatgattttcagttgttgcacatcttgagtggatacagttcagattcctaaccaatcaatttaattatttggaaaaaaataaaagatatgtaaaggaataagatgagactgtgatggggtttagtccccatttgataaaccatgagatggaaaattctgaattgatgccacagataaatgaatcaaccatgactaaacataattcagaagcaaaactgaaataactcctcaacaatgagtggactcataacactctgctgcagaataccctgatgctacagaagtctctagagtttggaaatctttaccaacaaagaaaaattctgatatattctctttcagttgaacgtcctcagatgactttttgcaggctccagagaatcttcccgaaggtgagtgtctctcagatctaaaggaccagagaacctttgtccctccatggatgcaaacactggtaagagtgggagaatataaaaaatgccctcactgcctccttctccccatgtctatcacaacacctgatgtagcaccaacagcttaataatactaacagttgtgatccttaatacatcttttgttttcatagtgatgccagatactattttaagcagttcacatggattaatgtatttaatccttaagaagacctgtatgactttgtttctattattatctccaaataataatgagtcacacacttcggttgtcgtccatataaaagccatgtgacttggcacaagtcttctaagttctctgagctccagattcctggtccatgaaatggaagtaaagaatcgtagttatcagcaacataataataaaatgaggctattggggtatagatatgttaaataattttcctggggcacagtggcagtggtagtctaatccagagctccaagccatttaaagctcattcacgtttgcatttgtttatgaagttcagatgttgctcactagggcttcaccccatagggcctgctggtgcttccattgagacacccattctcgcaataggaaagaccagctggcctctgctctgttactgggaccacttgcatggcttaggaatcgttttgactgttggcccctccctactgtgagctccttgaggaccttgtctgcacctggggcatcccagaagcccccatcccagcccaggggatccctcggaggcccctgaatgagtgaccccacaagtgcagattcaactctggtttagagggtaaagggatctgggagttgggttgctagtgtggagaccgaattgaaggaaggatcatgaaaggtattaattgttattattactgcatttaaacagtgtttacaagctcagagaggactttcccgtagactattttacatgtattgttcactatctcataagcaaggaagctgaataaaaagtagattaagagcggggcacggtggctagcgactgtaatcccagcactttgggaggctgaggtggatggatcactaggtcaagaggtcaagaccatcctgcccaacatggtaaaacctcatctctattaaaaatacaaaacttagcggggcgtggtagcgcctgcctgcagtcccagatactctggaggctgttgcatgagtcacttaaacacaggagttggatgttgcagtgagctgagatcgtgccactgcactgcagcctggtgacagagtgagactctgtctcaaaacaaaacaacaaaaaaaaaagtagcttaagattgttggtcagtgacacatcccaatgcaaccagaattggtatgggtaccacctcactgaattccacattcagtgttggtgcctcggtagggtggtatgccagatctggtactgctttcttcgctgcctagattaattttagcaaaccatttctttacctctcccttccctgtattaatctccccacaccatctttcccagcagtgttttgtcccctctctatgtttttacatttactctcccagcagctaagagcttatatgagatcccttgtatttcatagaagctcttccttttgtagaccttgtgaattttaaaaatgctatccttcttccaatcttttgtataccaaactctcaattgcatggagatttttactgtttgcaagaatgtcagtcttaaagagtgtgaagataagcattctagccctggaaacgatattcacataggccattcctttcccgtctaacttcccaggtttctcctaatttaggcatgtgtaactctcccagcattgttgagaacattgattaaggtaatgcatgtgaagacgctttgtaagctctaaagcactatagaaatgtcactgattctgtttatctgtgaccttcacattataaagatcatgcccaagaagccagcagaggaaggaaatgattcgaagggagtgccagaagcatctggctcacagaacgatgggaaacacctgtgccctccaggaaaaccaagtacctctgagaagattaacaagacatccggtaagaggaaagaattcgggaacaaaccctctggcttccgtggctatgttcaggtgtgtggactgggtgtgtggcatggaccccagacaagcctgggtccaggctgggctgaggagctcgcccagctccagatgagatgtttgactggacttccagagatacagactggagttgtcacccatatacaaaccacgtgacttggggctagtcttccaaattttctcagttccagattcctagtccataagatggaaataaagaatcatagttcataaattgtttggagacattaaatttaatctagaaggcctgatgacatgaaaggtgctcaagcgattctatctttgataacctgggataatatcttactcagctcaatgcctgatacccaataaagttgtacttcagagatattgcagattcggttccagaccactgcaataatgtgagtcacacacattgtttttttggtttagcagtgcataaaaacattatgtttacactatactgcagtctactaagagtgcaatagcattatgtctaaaaatgtacatacctttattttaaaataattcattgtcaaaaatgctaataatcttctgagtcttcagtgactcactctttttgctggtggagggtcttgcctcggtgttgatggctgctggctgatcaaggtggtggttgctgaagggtggagtggctgtggcagtttcttaaaagaacacaacaatgaaatttgccacattgattaactctctgcttcatgaaggatttctctgtagtatgtgatgctatggacagcattttacccacagtagaacttctttcaaagttcgagtcaattctctctagctatgaaagtcctagaaggcatctccttccaatagaaggctattttatctacattgaaaatctgttgtttagtgtagccaccttcaacagtgatcttagctagatcttctggataacttgctgcagcttctccatcagggtttgctgcttcaccttgcacttttaagttatggagatggcttctttccttaaacttcatgaaccaacctctgctagcttcacacatttctcctgcagcttcttcacctctctcagctttcatggactggaagagagttctggtcttgctctgaattagactttggcttaagggaatgttgtggctggtttcatcaaatatcctgaccactcaaactttctctatttgagcagtaaggcagttttgctttcttattcgtgtgttcactggagtgttaatattattatttccttcaaggactttccctttgcattatatactattatttccttcaagaacttttcctttgcattcacagcttggctgtttggtgcaagaggccgagctttcagcctgtcttggctttcagcatgccttcctcactaagcttagccatttctagcttctgatgtacagtgtgagacacgcgactcttcctttcatttgaatacttagcggccattatagggttgtcaatcatcctaatttcaatataggtgtgtctcaagaaatagggaggtccaagaaaaggaggagagatggggaatagctcatcggtggagcagtcagaagacacacaacattaatcgattaagtttgtcatcttctatgggtgcagttcctggtacccaccccccaaacaattacacagaacagggtgattattgtcaataataacttaattgtacattttaaaaaaactagaagagtgtaattggattgtttataacacaaggataagtggttgaagggatggataccctattttccatgatgtgattattacgcatggcatgcgtgtatcaaaacatctcacgtaccccataagtatatacacctactgtgtatgcacaaaaataaaaaacacggacgggcgccgtggctcacgcctgtgatcccagcactttgggaggccgaggcaggcagatcacgaagtcgggagatcgagaccatcctggctaatacggtgaaaccccgtctctactaaaaatacaaaatattagccaggcgtggtgacatgctcctgtagtcccagctactcgggaggctgaggcaggagaatcgcttgaactggagaggcagaggttgcagtgagctgagattgctccactgcactccagtctgggcgacagagcgagacttcatctcaaacaaaataaaataaaataaaaattaaaaattaaaaaattaaaattattttaaaagactaaaaaacaacaaaaacaatttcagtaataatatcaaagctcactgatcacagatcactataacagatataataataacggaaaggtgtaaaattgatgagagtttccaaaaaaaaacattgcagcatctgtgaagcactatgaaaatgttgtgcaataaaaaaaagtatgcctcggtgccctcaataaaaacacgtgctgaatgaaaggaggtaagggtggatgttcccgtaagtgaaaaggttgggaatctaaaccccacaacagaaggagccagaagctaaaactttaattggcatttggcctgtattggtgtgggtctaaggtctcagcctctctaagccagagaatgtgaaaaactggataaagaaggcccatgggcacttgggaggggggaggcatctcctttttttgagaaaacagagcctaacactctccaacctacccaaccctcactttccaactattctccatcacaggacccaaaagggggaaacatgcctggacccacagactgcgtgagagaaagcagctggtgatttatgaagagatcagcgaccctgaagaagacgacgagtaactccgtaagtgaaccttcggctcatcccccacatccctgcagatgtggtattctgttatgatactggtatcccatctgtcacttgctccccaaatcattcccgtctcataattttctagggtacagcattgaggccgaatgatgagagatttcccacgttttttttttttttttgacggattcgccctttgtggcccaggctgcagtgcagcagcatgatctccgcttactgcaagctccgcctcacgggttcacgccattctcctgcctcagcctctccagtagctgggactacaagtgcccgccaccacgcccgggtaattttttttgtatttttggtagagacggggtttcaccgtgttagccaggatggtctcggtctcctgacctcgtgatccgcccgcctcggcctcccaaagttctgggattacaggcgtgaaccaccgcgcctggccttcgtaagctctttttactccctgccctgtatatccaggaatgctccctacccaggatgctgtgggttcccgaactccagatcagccctgtatgtgggccacaccttcctctagcctaggaatggataacccaggcgaagaagtcactgtggcatgagcggatggttcacttcaaggaaccatggaaggcgtgtgcaggtcctggggtagggcagaatcagagtgtgcagggtctgcaggtcaggaggagttgagattgagttgtcacgtggtgggaactcactgccacttactttccttctctcttcttgcctcagcctcggggatacgacatatgcccatgatgagaagcagaacgtggtgacctttcacgaacatgggcatggctgcggacccctcgtcatcaggtgcatagcaagtgaaagcaagtgttcacaacagtgaaaagttgagcgtcgtttttcttagtgtgacaagagttcgatgttagtgtttccattgtattttcttacagtgtgccattctgttagatattagcgttttcattgatgagcaagacatgcttaatgtgtatttcggtttgtgtatccatgcacctacctcagaaagcaagtatagtcaggtattctctccatagaacagcactaccctcctctctccccagatgtgactactgagggcagatctgagtgtttaatttccgattttcccctctgcatttacacaccagacacacaaacacacacacacagacacacacacacacagacacaccaagtaccagtataagcatctcccatatgcttttccccattgccatgagtcctggtcaagccccccttcaatttgtttcctgttcagcatgtactcccctcctctgattccccgtatcagtca

SEQ ID NO: 3403 - DNA, 4001 bp, human
ataatttggcgaggaagatcaacatgtaggcctagaccaagacgaagtttacaacctcctgagctgattgggagtatgcgtgagtgctttaacattcgttgttttctattagcagaaattatttttttttgtgatagtgtcattgaactagtatgcatacactgttaaaggtcttccgagctgataaaaaatgatcatggcatctcatgaaggaaagactggtccaagaggattacgttgtgtgtgttttttttggagacggagtcttgctctgtcacccaggctcggctcactgcaacctccgtctcctgggctcaagcaattctgctgcctcagcctcccgagtagctgggactacaggtgcacgccgcctcgcccagctaatttctttttgtattttaatagagacggagtttcatcatgttgcccaggctggtcttgaacccctgagctcaggcaatccgcctgcctcagcctcccaaagtgctgggattacaggcctgagccactgtgcccagcctacattctgattttgcctggatggattccccagattttgcccatgacttcctccgtatgcttattcataacagattgcacacatccatcccaacatagattaaactgccttccaaagcccttgagtgtaactctgtcttagagtaacctctctgtgggaagaataactttatgaataataagtatgtggaatagtgttggagaaatgtctttagacttatgatcagaaatatctatgtattctgtatatttgcattattgacatgtatttataacaaaactttttttttttttcccgagatagagtcttgctctgtcacccaggctggagtgcagtggtgtgatctcggctcactgcaacctccgcttcccgtgttcaagcgattctcctgcctcagcctcccaagtagctgggattacaggcatgcgccaccacgcccgggtaatttttgtattcttagtagagacaaggtttcactgtgtttgctaggctggtctcgaactcttgacctcgtgatctgcttgccttggcttcccaaagtgctgggcatgaaccactgcgcccggccaaaactttttatttatacacacacaaccacagtcccaggagcccagtgatgaggagcctcgagaggaaccaccaactgaaagtcgggatcctacacctggtcagaagagggaagatcagggtgcagctgatattcaaggtggtgggaagggaaagaaagaacgtctatggggggaggaggcctatgtgtgcatcatgcattatgccatgaccggtaacaggaggaaagaaaacattaggaaaggatcgcaaacatttgctgaaagttggctggaaaagtgaagagtacagtttacagcttcatgcagtccctggatataaggaatcttctcctaactttgaaatatattttgtgcctccctctccctctccctctccatctccctctccctctccccacggtctccctctctttccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggcgtttcgctgtgttggccgggctggtctccagcctctaaccgcgagtgatccgccagcctcggcctcccgaggtgctgggattgcagacggagtctcgttcactcagtgctcaatggtgcccaggctggagtgcagtggcgtgatctcggcttgctacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggaggtgaggagcgtctctgcctggccgccccatctgagaagtgaggagaccctctgcctggcagctgccccgtctgagaagtgaggagcctctccgcccggcagccaccccatctgggaagtgaggagcgtctccgcccggcagccaccccgtccgggagggaggtgggggggggtccaccccccgcccggccagccgcccgtccgggagggaggtgggggggtcagccccccgcccggccagccgccccgtccgggagggaggtgggggggtcagcccccccgcctggccagccgccccgtccgggagggaggtgggggggtcagccccccgcccggccagccgccccgtccgggaggtgaggggcgcctctgcccggcctcccctactgggaagtgaggagcccctctgcccggccaccaccccgtctgggaggtgtacccaacagctcattgagaacgggccatgatgacaatggtggttttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaatgtcgcctgtcaagcgactgcttatgaagggttattcctcaactaaatatttctaaatgagtctgaggtctgttggccttcaatctctaccaaaacccagagaacttgatgatgcctttgttttcagagaatccttccagtgtgctggctgacagttccatgaggatggcaaaagtgaagaaattgtagcgccagtaaaaaagagatggatacacttcttgggaattttttaagctatgggacatgatgaattaatggtgcatgagtatactcttcactgtgaaagtttttgttttcacatctttcattagatgtgtgtaagaaaaagatactgaacgtagtatctactaacccaataatgaaaaggaatgccatttgctatttacactttattactaaaataaacctaaatttaattaataaattttggaaacataaaaaaaaagaaatatattttgtgtacttgaaaatacagtccttgctaaatcagatgaagcagtttaattttatgcataaatatgcagtgtgccattagtttaatttgttcttcttagaatgttgttgtataatcttctaagccattgtgtcaacagtgctgtaagcaccctttaacagcatgtggagtgccaagtcatcctaccttataacaccctgaataaagcccatttgcgtaaggatggtagccccattttataaataagcaaactgaggctctgaaatggaggtttaccaagaacctttgtactcatggagacagaattcatattttgtcccaaggtttgtgttatccatgttgtaataagaaaaggtcagtggttttgcttaagatacttactattcgaatgtgtgtgtactgtaaagtacttcagtattggctcaggacgaaacacagttcagtgaagcagaata

SEQ ID NO: 3404 - DNA, 4999 bp, human
ataatttggcgaggaagatcaacatgtaggcctagaccaagacgaagtttacaacctcctgagctgattgggagtatgcgtgagtgctttaacattcgttgttttctattagcagaaattatttttttttgtgatagtgtcattgaactagtatgcatacactgttaaaggtcttccgagctgataaaaaatgatcatggcatctcatgaaggaaagactggtccaagaggattacgttgtgtgtgttttttttggagacggagtcttgctctgtcacccaggctcggctcactgcaacctccgtctcctgggctcaagcaattctgctgcctcagcctcccgagtagctgggactacaggtgcacgccgcctcgcccagctaatttctttttgtattttaatagagacggagtttcatcatgttgcccaggctggtcttgaacccctgagctcaggcaatccgcctgcctcagcctcccaaagtgctgggattacaggcctgagccactgtgcccagcctacattctgattttgcctggatggattccccagattttgcccatgacttcctccgtatgcttattcataacagattgcacacatccatcccaacatagattaaactgccttccaaagcccttgagtgtaactctgtcttagagtaacctctctgtgggaagaataactttatgaataataagtatgtggaatagtgttggagaaatgtctttagacttatgatcagaaatatctatgtattctgtatatttgcattattgacatgtatttataacaaaactttttttttttttcccgagatagagtcttgctctgtcacccaggctggagtgcagtggtgtgatctcggctcactgcaacctccgcttcccgtgttcaagcgattctcctgcctcagcctcccaagtagctgggattacaggcatgcgccaccacgcccgggtaatttttgtattcttagtagagacaaggtttcactgtgtttgctaggctggtctcgaactcttgacctcgtgatctgcttgccttggcttcccaaagtgctgggcatgaaccactgcgcccggccaaaactttttatttatacacacacaaccacagtcccaggagcccagtgatgaggagcctcgagaggaaccaccaactgaaagtcgggatcctacacctggtcagaagagggaagatcagggtgcagctgatattcaaggtggtgggaagggaaagaaagaacgtctatggggggaggaggcctatgtgtgcatcatgcattatgccatgaccggtaacaggaggaaagaaaacattaggaaaggatcgcaaacatttgctgaaagttggctggaaaagtgaagagtacagtttacagcttcatgcagtccctggatataaggaatcttctcctaactttgaaatatattttgtgcctccctctccctctccctctccatctccctctccctctccccacggtctccctctctttccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggcgtttcgctgtgttggccgggctggtctccagcctctaaccgcgagtgatccgccagcctcggcctcccgaggtgctgggattgcagacggagtctcgttcactcagtgctcaatggtgcccaggctggagtgcagtggcgtgatctcggcttgctacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggaggtgaggagcgtctctgcctggccgccccatctgagaagtgaggagaccctctgcctggcagctgccccgtctgagaagtgaggagcctctccgcccggcagccaccccatctgggaagtgaggagcgtctccgcccggcagccaccccgtccgggagggaggtgggggggggtccaccccccgcccggccagccgcccgtccgggagggaggtgggggggtcagccccccgcccggccagccgccccgtccgggagggaggtgggggggtcagcccccccgcctggccagccgccccgtccgggagggaggtgggggggtcagccccccgcccggccagccgccccgtccgggaggtgaggggcgcctctgcccggcctcccctactgggaagtgaggagcccctctgcccggccaccaccccgtctgggaggtgtacccaacagctcattgagaacgggccatgatgacaatggtggttttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaatgtcgcctgtcaagcgactgcttatgaagggttattcctcaactaaatatttctaaatgagtctgaggtctgttggccttcaatctctaccaaaacccagagaacttgatgatgcctttgttttcagagaatccttccagtgtgctggctgacagttccatgaggatggcaaaagtgaagaaattgtagcgccagtaaaaaagagatggatacacttcttgggaattttttaagctatgggacatgatgaattaatggtgcatgagtatactcttcactgtgaaagtttttgttttcacatctttcattagatgtgtgtaagaaaaagatactgaacgtagtatctactaacccaataatgaaaaggaatgccatttgctatttacactttattactaaaataaacctaaatttaattaataaattttggaaacataaaaaaaaagaaatatattttgtgtacttgaaaatacagtccttgctaaatcagatgaagcagtttaattttatgcataaatatgcagtgtgccattagtttaatttgttcttcttagaatgttgttgtataatcttctaagccattgtgtcaacagtgctgtaagcaccctttaacagcatgtggagtgccaagtcatcctaccttataacaccctgaataaagcccatttgcgtaaggatggtagccccattttataaataagcaaactgaggctctgaaatggaggtttaccaagaacctttgtactcatggagacagaattcatattttgtcccaaggtttgtgttatccatgttgtaataagaaaaggtcagtggttttgcttaagatacttactattcgaatgtgtgtgtactgtaaagtacttcagtattggctcaggacgaaacacagttcagtgaagcagaatagcaactccagaaaagagctcaataaatgacagccactctttgattggtatccttctgtattttttcaggatgtttggcaaaaggtgggtaattcaggacactggcatacaggtagctatattagtatgatttcgaaggggcttttaaaagttgtagaagcactttcataattagaaaactcaaagtaccataagtttatcctgaatcagaagttgtttactcagtagatagcatttttgcgttaaacactggcagaatttgggccatggattattttagcaattcactgttaagaggtttccagaatatgactgtcaacaatgaccactaatttatttgcactcaacctcctgtacccttactggaagatagtgattttcctgttatttttggtacattattctaaatgtgattcatttatgtaaagttacatatggggcccttagacctaagcataatgttaatttatctaaataattttcaagttacctcaacaagggatgggtgtcacaattgtaagatgtctcataggcaggccaatacgttgatctaatccttcagaaaactgcatttcatttaggattaaaattctatccatgtggcagacttcagatttcttagtcgatattcactgttcataattcacaatggtaaagtatgggaaatgtaggtgtggtgtgatttatcctcagattatcatttaagataagattccataatataggaaaacaaaaatgtgacatctttacatcacatttattaccacagtagtctacaggcttttatttcataacactgaggaaaatagtattatcatttccttatttgtctttcttgtttgcctgcttcaatcaagaacctctgtatttttcagtgcctgacctggaagctgatctccagagctgtctcagtcaaagactggggatgaatgcggagatggtcctgatgttcaggggacaattctgccaaaatcagagcaatttaaaatgccagaagga

SEQ ID NO: 3405 - DNA, 5001 bp, human
ataatttggcgaggaagatcaacatgtaggcctagaccaagacgaagtttacaacctcctgagctgattgggagtatgcgtgagtgctttaacattcgttgttttctattagcagaaattatttttttttgtgatagtgtcattgaactagtatgcatacactgttaaaggtcttccgagctgataaaaaatgatcatggcatctcatgaaggaaagactggtccaagaggattacgttgtgtgtgttttttttggagacggagtcttgctctgtcacccaggctcggctcactgcaacctccgtctcctgggctcaagcaattctgctgcctcagcctcccgagtagctgggactacaggtgcacgccgcctcgcccagctaatttctttttgtattttaatagagacggagtttcatcatgttgcccaggctggtcttgaacccctgagctcaggcaatccgcctgcctcagcctcccaaagtgctgggattacaggcctgagccactgtgcccagcctacattctgattttgcctggatggattccccagattttgcccatgacttcctccgtatgcttattcataacagattgcacacatccatcccaacatagattaaactgccttccaaagcccttgagtgtaactctgtcttagagtaacctctctgtgggaagaataactttatgaataataagtatgtggaatagtgttggagaaatgtctttagacttatgatcagaaatatctatgtattctgtatatttgcattattgacatgtatttataacaaaactttttttttttttcccgagatagagtcttgctctgtcacccaggctggagtgcagtggtgtgatctcggctcactgcaacctccgcttcccgtgttcaagcgattctcctgcctcagcctcccaagtagctgggattacaggcatgcgccaccacgcccgggtaatttttgtattcttagtagagacaaggtttcactgtgtttgctaggctggtctcgaactcttgacctcgtgatctgcttgccttggcttcccaaagtgctgggcatgaaccactgcgcccggccaaaactttttatttatacacacacaaccacagtcccaggagcccagtgatgaggagcctcgagaggaaccaccaactgaaagtcgggatcctacacctggtcagaagagggaagatcagggtgcagctgatattcaaggtggtgggaagggaaagaaagaacgtctatggggggaggaggcctatgtgtgcatcatgcattatgccatgaccggtaacaggaggaaagaaaacattaggaaaggatcgcaaacatttgctgaaagttggctggaaaagtgaagagtacagtttacagcttcatgcagtccctggatataaggaatcttctcctaactttgaaatatattttgtgcctccctctccctctccctctccatctccctctccctctccccacggtctccctctctttccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggcgtttcgctgtgttggccgggctggtctccagcctctaaccgcgagtgatccgccagcctcggcctcccgaggtgctgggattgcagacggagtctcgttcactcagtgctcaatggtgcccaggctggagtgcagtggcgtgatctcggcttgctacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggaggtgaggagcgtctctgcctggccgccccatctgagaagtgaggagaccctctgcctggcagctgccccgtctgagaagtgaggagcctctccgcccggcagccaccccatctgggaagtgaggagcgtctccgcccggcagccaccccgtccgggagggaggtgggggggggtccaccccccgcccggccagccgcccgtccgggagggaggtgggggggtcagccccccgcccggccagccgccccgtccgggagggaggtgggggggtcagcccccccgcctggccagccgccccgtccgggagggaggtgggggggtcagccccccgcccggccagccgccccgtccgggaggtgaggggcgcctctgcccggcctcccctactgggaagtgaggagcccctctgcccggccaccaccccgtctgggaggtgtacccaacagctcattgagaacgggccatgatgacaatggtggttttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaatgtcgcctgtcaagcgactgcttatgaagggttattcctcaactaaatatttctaaatgagtctgaggtctgttggccttcaatctctaccaaaacccagagaacttgatgatgcctttgttttcagagaatccttccagtgtgctggctgacagttccatgaggatggcaaaagtgaagaaattgtagcgccagtaaaaaagagatggatacacttcttgggaattttttaagctatgggacatgatgaattaatggtgcatgagtatactcttcactgtgaaagtttttgttttcacatctttcattagatgtgtgtaagaaaaagatactgaacgtagtatctactaacccaataatgaaaaggaatgccatttgctatttacactttattactaaaataaacctaaatttaattaataaattttggaaacataaaaaaaaagaaatatattttgtgtacttgaaaatacagtccttgctaaatcagatgaagcagtttaattttatgcataaatatgcagtgtgccattagtttaatttgttcttcttagaatgttgttgtataatcttctaagccattgtgtcaacagtgctgtaagcaccctttaacagcatgtggagtgccaagtcatcctaccttataacaccctgaataaagcccatttgcgtaaggatggtagccccattttataaataagcaaactgaggctctgaaatggaggtttaccaagaacctttgtactcatggagacagaattcatattttgtcccaaggtttgtgttatccatgttgtaataagaaaaggtcagtggttttgcttaagatacttactattcgaatgtgtgtgtactgtaaagtacttcagtattggctcaggacgaaacacagttcagtgaagcagaatagcaactccagaaaagagctcaataaatgacagccactctttgattggtatccttctgtattttttcaggatgtttggcaaaaggtgggtaattcaggacactggcatacaggtagctatattagtatgatttcgaaggggcttttaaaagttgtagaagcactttcataattagaaaactcaaagtaccataagtttatcctgaatcagaagttgtttactcagtagatagcatttttgcgttaaacactggcagaatttgggccatggattattttagcaattcactgttaagaggtttccagaatatgactgtcaacaatgaccactaatttatttgcactcaacctcctgtacccttactggaagatagtgattttcctgttatttttggtacattattctaaatgtgattcatttatgtaaagttacatatggggcccttagacctaagcataatgttaatttatctaaataattttcaagttacctcaacaagggatgggtgtcacaattgtaagatgtctcataggcaggccaatacgttgatctaatccttcagaaaactgcatttcatttaggattaaaattctatccatgtggcagacttcagatttcttagtcgatattcactgttcataattcacaatggtaaagtatgggaaatgtaggtgtggtgtgatttatcctcagattatcatttaagataagattccataatataggaaaacaaaaatgtgacatctttacatcacatttattaccacagtagtctacaggcttttatttcataacactgaggaaaatagtattatcatttccttatttgtctttcttgtttgcctgcttcaatcaagaacctctgtatttttcagtgcctgacctggaagctgatctccagagctgtctcagtcaaagactggggatgaatgcggagatggtcctgatgttcaggggacaattctgccaaaatcagagcaatttaaaatgccagaaggagg

SEQ ID NO: 3406 - DNA, 5542 bp, human
gtgagggtgtgagggtcgcgttcctgctgtctggactttttctgtcccactgagacgcagctggtaggtccgcaggccagtcctcccaagggttgaagtgtgagtgcgtgtgaggaggagccagtggctgtccggagcgtgggaaagcatggcccgtggcctcagaggccgaagggtctcaaggtgatcgtccttctcctcgtgaggtggcactgccatgggccttgttgtggtgaagtcagaatgagggaagaaggtgggccgcgtagttgagaggggtcaggtgaaaatggggcgagtgctgggggtgctggggcaggtatccgagtccctggaaccctcgaccgaggacggattccagactcctccgtgtcgacccgggaaggagcagggtgggcattaaggaagggaactgggaacgctgcgggttggtgactgtggccctgaggtctgtaaagcgcctggcagaggtgtacagtgaggagggcccagagctgtgtggcaacttctcaactccactgtggaggtttgaatgggcggggctctgcattccaacaaaacttgattttaggggggaaatgggcccagcaaatgggtgtgtgacaaaagccgtggtcactgcagttttaattctctggctgtattttcccaaatgtctccacggaggagagttcagttgtgaaaccaaacctcatcggaaatatcctgtcttttgccaggagccttaagaaattgctcagctagcttgaccaacttaatggcttcccaagcattcagaaggcacacatacttacacttgccctgagacttagttcgaaagtatttacaaacttttaaaaaatgacaagttaatatttggtcatggaagtggtcaaatatagctgtcttttcaagtgcatttaccaattcacagtattctgtttgcagtgtgaaatatgatttggcgaggaagatcaacatataggcctaggccgaggagaagtgtaccacctcctgagctgattgggcctatgctggtgagtgccttaacctttgatgttttctattagcagaaagttatttttgtaacttgttgttgttgcaaaactatgttttgtaattgttgttgaaccagtatagatataccaataaaggtctcccatgctgagaaaaataatcatggcatctcatgaaggaaagactagtccaagaggattaagttcttctgttgtctggatggatgatcttgtgttccccagattttgcccatgatttccttctcatgcttatttgcaaaagattacacacattcatcccagcttagattaaaacagcttccaaagcccttgagggcaactgtcttagagtaacctctctgtgggaagagtaactttatgaaaaataagtatgtggaatcgtgttggagaaatgtctttagacttatgatcagaaatatctatgtattctgtatatttgtattattgaaatgtatcgataacaaaactttttatctgcacacacacacacacacacacacacacccctggttccaggagcccggtgatgaggagcctcagcaagaggaaccaccaactgaaagtcgggatcctgcacctggtcaggagagagaagaagatcagggtgcagctgagactcaaggtgctgggaagggaaagaaagaatgtctatggggaggggaggaggcctatgtgtgcatcatgccttatgccatgaccagtaacaggaggaaagaaaacattaggaaaggatctcaaacatttgctgagagttggctggaaaagtgaagagtatagtttgcagcttcatggatataatgaatcttctcttacctttgaaatatatttcgtatgcttgaaaatacagtccttgctaaatcagatgaaactgtttaatttgatgtacaaaaatatacattatttcactagtttactttgatcttcttagaatgttgttgtctgatcttctcagccaaggtgtccacagtattgtatgcaccctttaatagcatgtagaatgccaagtcaccctacctgaatacactgaataaagcccatttgcataaggatgttagccccattttataaataagaaaactgaggctctgaaatggaggcttaccaagaacagttgagtcatggagaaggaattcatatttcattccaaggtttgtgttctccctaccattcacattagaaaacgtgaatgattttgcttgaaatgttaatactcaaatgtgtctgtactgtaagtacttcagtattggctcaggacaaaacaaagttcagtgaagcaggatagcaacgccagaaaagagctcaatgaatgacagccactctttcctttgctttgtatttttgaaagtatgtttggtaaaatctggataattcaggacattggcatacaggtagctatattagtatgattttaaggggcttttaaagagttgtttatatacttttataattagaaaactcgaagtacgataagattatcatgaaacagaaattatttcctcaacagagagcattttgaagttaaacattgacagaatttgggtcatgggttactttagcaattcactgttaaggggtttccagaatatgactgtcaacaatgcccattaatttttttttcactcaagtttctgtactcttgtggaagacagcgattttgctgttatattcggtatttttttgtgaatgggattcatttatggaaagttacatatagggcctttggacctaagtttgtttaattttaaccaaaaaattttcaagttacctcaacaggtgatgagtgtcaggactgtaagatttgtcataggctcaccaatatattcatctaatctttcagaaaattacatttaagttattattaaaatgctatccattgggcagtctttaggtttcctagatagctgacactcactgtttatagtacacaatggtaaagtataggaaatgtaagtgtggtctgatttttcctcagattgtcatttaagataagatttcatagtacaggaaaacaaaggtgggacatctttgcatcacatttattaccacagtcgcctgcagccttttatttcataacattgaggaaaagaatattatcatttccttctttatctttcttgtttgcctgcttcaatcgacaacctttgtattttttagtgcctgacctggaagctgatctccaggagctgtctcagtcaaagactgggggtgaatgtggaaatggtcctgatgaccaggggaagattctgccaaaatcagaacaatttaaaatgccagaaggaggtatgctatccattattatgtgctttctgttttccacaatattatacttttgataataaaagagaacattactatccctttaaaatcagagttcaaatgcagactttttttgaaaggttgttcagaccccaattgcctgactgtaagacttaaacactatcagctacagacacaaattgggtcaaacccacattgaatcatcaaatatgaaagcatattcttacttctgattatacccaacaactaacaattttcagatatttttcaatttctgcttttaacaaatacataatgcatttgtaataccactttgtgtgaaatatcctgagcaccttaagcagattctaataacagctctaacattatttgtgagattctggatgaattccataaattctacaaccatcttttgctgttattgaaaatagtaaatgcatatcagatgtattaacatctgtttcaaaattgatttctgtatcctcatgttctgttggatagaatacaaagatatgatttgtttttcataacaatcagtttcgctccagttataatatctgagttgagatttcatggttcctaagaaaatgagtgggcaacttgcttcatgaaagtatcttttccacatattttccaaattgatgactgttaatcagaagagcttctgaatttataggaagcattccatatttatggaagaaattgcctaaatggttttactctatactgctgaaccattccattagactatttacatgaaagatagttttcaattatttccaggagcccattgagcaatcctcaattgtattcttaggaagatagtcttaagtgagtatcttgttaaaatagatagaaaattacacgagaaaggaaaatattaatgaaaattataaagagcaatagaataaatctaagggaaaaggaaagaggtccttaataagagacagatatgagtcattagtaaaaggaaatgtaatccaaaagtaatacatttaaaagattgttcttttgaaaaatagctatgaatagagtaatagtttacacactcttgaagaaaatggaaaaagctcaacatggaatatgaacaagaccctaacagatactgaatatatggtataatcgaaagtgaatacattcttgaactctagtattttcgaagtatgaatgaaatgattgatatgctaggaacacatacattagttaatttattccagtaatacctgaacatctaagcatcacaaagagtgtgggaaaacttctgaaagttcccacttatccctcaaaaacacttaacttttagaaacaattatttggcttttccagatgtcttactgtccttttctattttcctctccctccatttctttttttgcccgactattcatgatatatgcctctttctcattttgatgtcaaaaataatagtgatagattaaaccaaatgtgaccatgtaatttattttaccaatgggaatactttcaagtgtaaaaagagggactcttcatattgacatcaggatgataggtgaaaatcttggacaaatggttaccgtaccttaaagaccacagaaggatgaactagccccaagcaatatttttggacttctgtgcaaagagaaaaaacaaatgcagtactgacctttcaattcactgcacttttgcagtccctaatgtgacataaattgtttcccaggagcttgttgaacatccagactattatttcaaggcaaaacattgcattacatgatacattgtttgtaaattccttttgtttcttaggtttgttgtgtgttggtcatatttttattaaaacaatacacaatgtttgcttttcactttgagccaccttttaataggttcacttgatttaaagtgctctgaagttagacagtttttggtttccttgaactacagaaggcaggatgttttaaaaatgttgctaatgtatatacttggaagcctatcttcaaagtctctacagaggtctaactgaatgttagccatcaggttactcttaggcttctggtttaatccacggtataaaaccaaaactttggtgtcctttgcctacctttaatgtcatctgaatacagttctgctactaatgttccctcctgttatatttctattataggtgacaggcaaccacaggtttaaatgaagacaagctgaaacaacacaaaactgtttttatctaagatatttgacttaaaaatatcgaaataaacttttgcagctttctccaa

SEQ ID NO: 3407 - DNA, 30014 bp, human
agtttgtgacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggc

SEQ ID NO: 3408 - DNA, 47172 bp, human
acgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagcca

SEQ ID NO: 3409 - DNA, 46864 bp, human
gattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccag

SEQ ID NO: 3410 - DNA, 40298 bp, human
agtttgtgacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtga

SEQ ID NO: 3411 - DNA, 47591 bp, human
caactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgttt

SEQ ID NO: 3412 - DNA, 46764 bp, human
caactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatcca

SEQ ID NO: 3413 - DNA, 48182 bp, human
gacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggacgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaa

SEQ ID NO: 3414 - DNA, 29891 bp, human
agtttgtgacaggcacgacgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagc

SEQ ID NO: 3415 - DNA, 46831 bp, human
acgattgcggagctgaagttcaggcagcgggagcgaggagggtgtgtggcttttgatacagtagagttctttggcctactcaccaactgacagtcccaaaggggctggagatgccaccccggcaaagttcgccctagtcatttgcttcacgtgagctctttcagtcttgtttatccttaactcggtgacaagcctagtctggcgcttttggcacggcaccatcgttcctcccgctacactcaattaatgtccagggagcggtctctgagcttgtttggtgtttgcctaggaagtaatgcgggtgaagcagtttcggggatgtgtatctttaggcatgacatctcagatgctgtttgggtgtatttgatcactctgggccgtttggggtccagattgtgtctgaatgggatattttatctcagtggattttgtgtgcctatgtgtctggatatgccttcttttcttttctcttgtttgttttcagagtctcactctgtcgcccaggctggagtgcagtggctgatcatggctcactgcagcctcatactcctaggctcaagctatcctcccgcctcagcctcccgagtagctgcgactataggtgctcaccaccatgcccggctaagttttttattttttattttgtagatatggagtctcgctatgttgatcaggctgtttttgaactcctggcctcaagtgatcctcccacctcggtctcccaaagtgctgggattacagacatgagccaccacgcctggcctgggtgtgcatcttctgagctttttggacatttgtgtccctgggtgtgagagctctatgtaggtgtctgcaccccaggatgtgaagtctctgagctgtttgcaattctgggtcccaagttgtgatgtttcccagctggtgttggtgaggacaattttgcttaaggtataaagtatctgagctgtttggaggagggaggggtctctgcccagaatgtaggttctctgatttgtctggggactttatcttaagattatgtgatgtttctgagctacttgaacttctgtttctgttttgtattaggttgggaggtgtctgagtggtttggggggggtctctgtctagggtgtgagatatctgaatggttttaatttgtttcccaggagtgagaactttggtctgttgtgtgtgggggtctttgtcacagcatgtgtggtctctgttctgtttgggggtctgtgtcaagttgtggggtctctgtgcagggattttggagtctgtttcaggttgtgagattagtgagctctttttgatgtctttgagtatctgagctgtttgggagtctgtgtctcaggagtgaaatttcttacctttttggctgtgaggtctcggtccaggaactatgggttttggaggctggcagacatgatttcaaagcctggagcccccaagtcttgattgtgtgacattgggcaagtcacttgtctccttgaacctcagtatgtatcataatcagtaaaatggggccaatatccatcttggagggcatctgtgcatcttagcaatgtgtgtaaagggccccactccagccatccttcaacaagaatttcctgagcgtctgctgtatatttgagtactgttctaggttctgcagatacaacagagaccaaaaccaacaacatccctgatagcatagagttggtcagtaaatatatagcacatcacagtgtggtaagtgctacgtagaaagttaagacagtggctggcgcagtggctcatgcctgtaatcccagcactttggtaggccgaggcgggcagatcacctggggttgggagttcgaaaccagcctggccaacatgatgaaaccccgtctctactgaaaatacaaaaattagccaggcgtggtggcagacacctataatcccagctacttgggaggctgaggcatgagaattgcttgaacccgggaggcggagtttgcagtgagccaaaatcgcgccactgcactccagcctgggtgacagagtgagattttgtctcaaaaaaaaaaaaaaaaaaaaaaagaaagttaagacagggtcaggtaaatgggtaagtgggcaggatgttattttattcagggtgtgtggggaaggcatccctggagaggtgatgactgagcagagacctggaggcagtgaggagcaggccttgcaattacctgagggaagagcattccaggcagaaggaacagcaagtgcaacagccctggagcaggggaagcacctggtgggtctgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttgaactatatggttgttacatgaacgtgcagcttattgcttgtcattaaaacatacacttaacgttttatacactctcaggcaaaaaaaaaaaaaaagactcacaagtgaagcagagtgctgtgggaagtgggagtcgcgtgagtgtccctgactcctgcacacaggctcgcagtgccctggcctgctggtgtggaccacacagcataggcggcctccttcctgcagaacctcccctgggctccaggtcttgccttctatcctggaggctccagaggctccctcaggcctgtttgtggagattgtctggtgggaaatcctctatcctgtgctcctgacgccagccatggagcaggaacaccacctctcaggggatagacaggatctgcccattttgtcctcagatgttggggtccatctcccctcaggcctcatttacacccacaatagcccaggacatgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgccgggcacagggcaaggctgagtacaggcccactgtcatctccctggctggaataggttctagcaataatgacatggatgtgtttggggggccactattctgcctaccacttaccctcttccttggcaagccttgatggtaactgtcattgtccccatactggggccacagaggtagacagatggatcttagcctccaagagagtgagtgcccaccctgtagaggagaacagcatgtcgcaggcagttcacagagtgatgccttttatatcactattgtgatggttagttttaggtgtctgcttgatggggttaagaaaaacccaaatagctggcaaaccattatctctgggtgtgtctgtgagggtgtttctggcctttgaatcagtgaaccgatggaggaagattggcgtgggtgggcattgtccgatccctcgagggcacaggtacaacaagaaggcggaggaaaggggaatttgctgtcttctggagttgggacaccccgtcttctcctgcctttggacataagaactccgggttttcaagccttcagactccatgaattatgcctctggctctgctggttctcaggcctttggactcaaactgaatcacaccatccacctccctggctctccagcttgcagatggagatggcgggacttctcagcccccacagtcacatgagccaattcccataacaagtcccctctttggttctgtttcttgggagaaccctgactaatacaaccattcataccaatactatcggtattcacctcaccgtgattctgtaccagacactggctgaccacctaacatgaatcatgcttttctcacccaactccgtgactgtcaactctacttctatcacccattcacaggtgagggccttctgtattctcatcagccccagctccgagcacagtcctttgccgaggccttcctggtcctcctcttcctcctcctccttctgaccagggccagcatcttttcttttcttttcttttcttttcttttcttttcttttcttttcttttcttttcttttttcttttctttcttttcttttcttttcttgacagtctcactctatcgcccactctggagtgcagtggagcgatctcggctcactgcaacctgcacctcccaggttcaagcgattctcctgcctcagtctccagagtagctgggattacaggtgcacgccaacatgcatggctaatttttgtatttttagtagagatggggttttgccatgatggccgggctggacttgaactcctgacctcaagtgatccacccgccttggcctcccaaaatgctgggattacaggcatgagccaccgtacctggccagagctagcatcttagtctcacagtggcccctgctcattctgtcctcagccctcagccctgctgtcacccacccacatcctacaacccctccacttcctcttctccgtgtctgttgtccagggtgggaccaagtccaaacctgagcttcctgctaagtcaaagtgaccttttcctttcagtcagggaagcctgactgaagcctgtggtcccacggtgaggtcttggtgtctccaggcacagtgcagccacgttgcagtgatatccacctttgccagcagggggcatctcatctccaagaccgggaaagcctcagagaagacagaggaacagtcttaaacattcactcctggtggggtcagaggcctcagggtgcatgagctccaggctgggtgtctcttggagcctccctctctgcatgtggacaggtaggggcagcctagggccaggttttagtgctgttggggtcatctgcagatggcttttcactccttcctacttcttctccttgtaccagaagctcatttccatggctaaaggaaaattctcatataattttgtcttccttttcttatttaatgattgcattatatgctttcttctacaagatgcactggctctgaggcaggtcaggctataggttggcgagtcctgagggcaccagcctggatcctgaagatactgggggcaggctccaacagagcctggggctcaggaaaaggccaccaaccccccagccagatcctggccagctgccggctccgcctccaccctgtcctctcccagggcctgaactctgggtctagaagctccaggcctggtggtttggggagacagggaccaggaggatccctcagaagaggaggcagcagacaatctccatacagcttgagggggtgcacagctgtggggtgaggcacggcccacccagcacaggcccactgacctgctgtgcagctgcaggcccagctgctgccctctacgacactcagtctcctcacctgcgcagtgagcatcattatacccccaacatgcaggggatgctcatgaatggaggggagctgaggcgttaataaagcagatttggcccaagaggaggaggagtgggtcagggttggtggggaaggacagatgcggccacctcagggacagccaggggctgccttcctggaagtgctcaggacagtcaggcgagggaagttctgaggttgtgagcagaaccatggtctggggaccaggtgagattttctctatagtgttctcgggtggccacctgctttgtcactgttccttcctgttgtcgtcatctctgcctatgggtgccccgagacgagcccagtgagctcactgtgagttactgcgacccacatgcagtcattagagccatgcgtcatcatcacaacagccaccaggttaacacttgggtaatttatccaaataatgactcacctgttctgacctgatttggattatatgccatcatttattgtagccatagtttattcagtcattctcctattggatcgttaattagtgtttgatttactttttgaccatccagacctgtgatgagaattcttgtacatgcaatgatgttcatagagtaaccctacttgtaatagctaaaaactggaaacaacccaactacacaccaataagaagttgcataaataaattctgccagattcacactatgaattactgcacagctatgagaaggaatgagctagaccatacagagacataacattaggtgactgaagccagatataaaagaggatatgctatgtgattccctttctacatggctcaaaagcaaataacaatagtgtttaggcatacatatgtctgtattataacagttttacagaaagcaaggattctaacctgtctggtgggcaaattttcttaatttttgaaattatacagtaaaatggacacttgaggtatagttctgtgaatttgaacacctgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtctcttttcttttcttttcctttcttttcttttcttttctttttttttttttgagacagagtcttgctctgttgcccaggctggagtgcagtggcgtgatctcggctcactgcaacctccatctcccgggttcaagcgattctattctcctgcctcagcctcctgagtagctgggattacaggcacgcaccaccatgccttgccaatatttgtatttttagtagagacggggtttcaccatgttggccagggttgtctcgaacttctgatccgcccgcctcggcctcccaaagtgctgggattataggcatgagccactgcgcttgaccccttgagtttcattcaaatcgttgaatatatcaatagttccttctttttttctgaataatattccattgtatgtgtgtagcagatcttgtttatccatgcacccattgaaggacatttgggtcatttctagtttggtacaattatgaatagagctgccataaacatttgtgcatggatttttgtgtaaacataaattttccttcttctaggataaatatcctggatgtccaatgtttccaacaccatttgttgaaaagactgttctctttctgttgaactatccacaaaaataaggcaaatagatttttttttttttttttgagacagggtcttactctctcacccaggctagagtgcagtgccacaatcacggtttgctgcacccttggcctctcaggctcaagcaatcctcagcctcctgagtagctgggactacaggtgtacaccagcacactcggctaagttttcttattttttgcagagatggggtctcactctgtcactcaggctggagtgcagtggcatgatcatgactcactgcagcctcgaccttctgggctcaagccatcctgcctcggcttcccaaagttcaaagtcattttgactgttgtagctcctttccctttccacataaattttagaatcagtttgtatctataaaagatcctgctgggaatttcattggaattgcatgaaatctgtacatcaatttggggacatcattcctataatgagtctgtaatccatgagtacagtacgtccctctctttatttaattgttcctttatttctttcattagcttctgatggtttttagcatacggctcctgcacatgttttgttaggttttcaggggcagctattgtaaatggtattgtatatttttaaaaatgttccaagcagttcattgctagtctatagaagtgctttgctttttgttgttgttgaacatatatcctataatgttgcttaactcccttgttcattcgagaagtattttttataaatctgacaagattttctatgtagattataataatgtctgtgagttggagtagttgtagtccctcctttccaatctgtaagccatttatttctttttctttcctttttaagctggttggaactttcagtacaatattgaataacaggggtgagaatgagcaaccttgtttggttcctgatgttatggagaaagcagttagtctttattaagtataatataaggtgtaggatttttttagttgctccatatcaagttaagcaagcctccttctaattctggtttgctgttttttttttctttaattatgaatgactgttgaattttgtcaaaggctttatctgtatcaactgttgtgaccatgtggttggagtttgcagttttttttcggtatattaatatggtagattgcattgacacatttttgaatattgaaccagctttgcattcccaagataaatcccacttggtcttggtgcattatcctttttatatattattggatttaatattaaccaaatgttttcttgataatattttgttgagaattttctgaatctatgttcatgagggagattacactatagttggttttttcttaatgctgtctttgtctgattttggtgtcagtgtaatgctgatcttataacatgatttggtaaatatttcaaccatcaattccatgttttttttttctgcagtgattttatttttttattttattttttaaattttattattattatactttaagtttagggaagtcagtgtggcgattcctcagggatctagaactagaaataccatttgacccagccatcccattactgggtatatacccaaaggattataaatcatgctgctacaaagacacatgcacatgtatgtttgttgtggcactattcacaatagcaaagacttggaaccaacccaaatgtccaacaatgatagactggattaagaaaattccatcttttaatagatggaatctatttagatgattggtttattttattattggtttattttattattattattatttttttttagtagagacagagttttgccatgttgtacaggctggtcttgaactcctgacctcaagtgatccacccaccttggcttcccaaggtgctgggattacaggcatgagccaccacagctggccaatgatctatttttgagtaagttttggtggtttgtgtctttcaaacaattgttccattttcatctaagttgcttaatgtatatgcattcatatatttgtgaattagtattcattagttattcatagtatccttttcatttttgtggggtctctaacttgtattaaagttttcaaagaacgagcttttgggccattgattttgtctgttctttttttttgttttcagtcttatcgatttcagctccaatctttatttccctcattctgcttactttgggttatttttattttctttttctagtttcttaaggtggaaagtttcataatgggtttgggtcctttattttttccaatatgataatgtaatggtataaatttactccctagcactgatttagctgcatcctgcaaattttaatatgttgtattttcatcttcattcagtttaaaatattttctaatttcccttgtattgctccttgacccatggattacttagaagtatatggattgtttaatttctaagtttggagattttcctgtttactttctcttattccttgttttttttttttcctattttgatcagagaacatgctctgtatgatttcaattattttacatttgggaagatttattttgtgacccaagatatgggctattttggtgaagtgtccatatgtactagaaaagaatgtatatcctcatgttgttatgtagatggttctgtaaatgtaaatacaattcagtgggtaaatggtgtcattcagttcttctatatccttgctaattttctttcaactatttctatgtattactgagagagaattgaaatctccaactataattataaatttgttcatcttttcctctatgtgtgattttgcttttgtgtttttttttttgtttttgttttttgttttttgagacagagtctcactctgtcacccaggctggagtgcagtggtgcaatctcagctcactgcaacctccgcctcccaggttcaagcgattctcctgcctcagcctcctgagtagctgggattacaggcatgtgccaccacacctggctaatttttgtattttttagtacagatggggtttcatcctgttggccaggctggtctcaaactcctgacctcaggtgatccacctgcctcggcctcccaaagttctgggattacaggcgcgaaccactgtgcccagcctgcttttgtgtttcgaaggtctgttgttcggtgctggcagaaaagggttaataatataggaagcctgagacttcccttagaagggcctgcttaccatgttggcccttgccaggcatcagggaacttggatttgggaaggattcccatgattcccttactctgcctaaactgtttgtacaaaatatagtttatgctgcataggtgctttcattctggaagtctggaatcttggcacatgctaggcagagggtgcctgtgtgaccagcccccagtaaaagtcttcaacactgaatctctagtgagctgctctggtagaaaatatgtcacatcacacatgtcacaattgatttctggaggaacgaattctgtgactttcctaaaaaaggactcctggaaacttgggctggtttcctcgggacattgccccatacacttttttttttgtgctgatattgccgtatacttccattgtaatgaatcttcaccaacatgagtccagctatatgctgactgtgagtcctgtgcgtcctcccagcaaataatcgaaaatgggagtggtcttggggacccctgacacagttgtgacagtggtgggatttgccagaatgagcctgactcactaaaatatggtgaaagccttgtttaagtaaagaaaggatgaaggagtaatgggtgatgaaccttttgtgctcgggcgattatggcctcacacacgctgtgaaacagcagctatctgttgtctcttgtgagaggtaaatgttacttacagaatttaaaaagaacacatccaactcttggagacttggatcactgcattccttggcgtcttttgccatgccggagattgtggggtgggagcacagccaggtcaaattttggtttttgtcctctcttccaaacaaaagaaagggactgggaattcacaaaagtaatgctggggtggatgaaaaatgttaaaaatttgggtttctctctcctccaggtgggagggaaaaattatatcagttctctgggctggagcaaagcttagataaaccaaagggaacaaaaagaaaaatttctccagccttttcttcagctttgctgctgctactgcagcccctcccagccttccagacagaatctcccctggcagctatgatgttaaccctataattgcaatgaaagccaaaaaaaggaattaaaaatagctttttttttgttttatggctgctgcatctggatgtatgataaaattgatgtgaaatgctatatacttataatgtaataaatgctagagggaccatccccttcagggaaggctggaggggaaatattttttcttttttattttgagacggtctcactctgttgcctaggctgcagtgcagtggtgcaatcatggctcactgtagcctcgaccttctgggttcaagcaatcctcccatctcagcctcacgagtacctgagatcacaggcatgtgccaggatgccaggctaattttcttatctttttgtagagatggagtttctctgtgttgtctaggctggtctttaattcctgggctcaatctgccttatgttagtcatttccagtgaacctgtaaagggccaaagccctcagctcctacacaacaaaggactaatagcctggctttgcttccctaacttttctcctggtgtacacaccttggtaaggcactttgaccattcaatgcagagctgtcaccagcaaagcattgaacttttccagcctgctcgtgaaataaatgatagagacaaaagggataagaagttatgcaaacctacataaatttatttttaaatctggaatttcatcctgatcagtttctgaacatgatgtgtattattggttgatttattaaaatttttttctctgaaaattcttttttccctcttgcatatgaccatttcagagaaaagatctagaggacggtagatgataagtaaagaaatgggaaggtcttttttttttaagagatacttggttttatttaaagtatatattgaattacattgagtgtctttatagtatctattgagattattattttttactttaactgattaatatatcgttacttacattaattgactttctttttaaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtatttttagtagacatggggtttcaccatgttggccaggctggtcttgaactcctgacatcaagtgatccacccaccttggccttccaaagtgctgagattacaggcatgagccaccacgcccagccttttaaaaaatataagtttttaaaaattttatttattttttgagatgggttctgctatgttggccaggttggtcttgaactcttggcctcaagcagtcctccttcctaggccttccaaagtgctgggattacaggcatgatccactgagatgatatctcattgtagttttgatttgtaagaagtggaaagttttgatttcagattagtacacactggttttctaacaatgaagaaaacacaaaacctgacatgtggaaagagtcaagccagagagaggggacattagtgatctctggttttcaaatggttcatgaaaaccttccccttttcctgaaaaaaaaaaaaagctcctcattcagccttcctaaatttctgtgagtatgttgaaatcatactgactgccgagtgcacaattacacctgacagagctgcaactaggggacagtaggggcaacccagctcctgagcatcccatgcagaacatctacagatgtcatccatgcttgtgaagaggaggaactggtgtcaatggttaacagaacctggactgactgccttctgtcagtccctcagaaaccaagaacacaaatgagttgtttggatggacgaggaaccctagagggaaaagtcccacagtgggaagccacactgggggccttggccagctcctgcctgactaatgtatgtcctgctgggggtgccctaacaagggtaaagtcttggtgtccaggggtaccacgtgtgccttctgggattgtacttgcatgtgcgccctgactattccatcactgcctcatccctggaaggcattcatgtcagcttcagtttcctgtccagattggtgctgagcctgaaatggagacttgggctggacaaaaaaaggttcatacacaatcttagttaggaagtcacctgcctttctaagatagaccttcatggttactgggatttgtattagttggctgtgatggtaaacttgatgtgtcaacttggcttggccacagtacacaggtatttgttgaaacaccagactaggtgtctctgtgaaggtgttttttaagatgagactaacattaaaatcagtagactttgagtaatgcaaattatactccatgatgtggctgggcctcattcaatcacttgaaagtcttaaagaaaaaaaaaaagactgggatccccccatgaagaaaaaattctgcctcgagactgcccttggattcgagctacattacctcttccctgggtctccagcctgacattctgctctgcacaatttagacttgccagcccccacagcctctctctctctctctccctctacacacacacacacacacacacacacacacacacacacacacacacacacacacacagaggaaccctaaccaaaaggctgcttacatctgggacccttaaagggcatagctgagatcagtactttggtctcactctgttgcatggctcctaaggcagaggcctctggcattctcctcccaccctctgcagactgccagccatggggctcatcactgtgactcagcgtttggtcatccaaccatgtagagatcactacaattccataagtgttccctgccctctttctgtctgtgaggtcctctatcccatcctgaggactcagggatctactgggcatgtttccaaccttccaggagagaccacagagcctggtgagggaaatacacctgcaaagagaagttcagtttagtaacagcaatgggcatagccggtgtgttcaccaactaatgagagatcacactaccaacatctcccgcttgattttccccatcaactaacagcttatcatggaaatgatccctttggtaggtaagttggattcccctcattgtttcccccaggcatgcagcactacaaagcaaattgatactggtatgttgtgtcagagtggaatccaagaatggaatgccctgcagtgatgtgatttctaaagcagtcaataagtctttgtaagtttccaggtgaagcaacatacaagccccggcccccgccacccagtttacagggaagtgatatatatggaaaaaaatccagtttatttaagactctggaaaaagttgtttgcctccctgtaaccttcactccacaaatgccagtagccgcttccaataatttgaacacccaaagctgcccttggaaatttccaaaatgccccaaaatgggcgatgatattctgactacaaaccacaagtttaggatttaaaagaagaatcctagaacttcttaataacatcaaaagtttaggaatgttgcagtcggtacagaggaaacagcacagtaacatggagaaggacacaatgttccccaggaggggttgcgggaaccttgttcctctgtgttgctttcttgtgataagaaagtgtttcagtgccagctggggtgtgtggtgaagcttcatttcaaaggtcaaccactgccatgggacattgatgctcaggatggttctgtggtagtcatggctctgggatcctgggactggtgtccttcttctcagtgaggacagccctctccaggctgtgacataggaggaacaggccaggctaggtcgtcaggctgccagggacaggtgtgtgctgtgggagaaggagaaggacagctggagggaggagaggggagacgaactccttaggtgaggggcaggtgtctgttggtgaagggaagacattggtcctaagtcctgacattgctctaggctcccgttgaaggaaatgacggtgcaagaaggaaaccaaggctggtgggagggggacaacagcttgcatctcctcccatcctatgtgttcagtggtccctgagaggagcccataccattttgggatctaaaaggtcatttcctgggaccccttcattcactgcccatgaagagaagggatttgagataaactgaggccttcaaggagaaaggccagtaggagttgtgaggccttctcaaaagtccctctgccctacccttacggtgagtctcacactgcgctcatcttgtcctgtgttactttgctctgaggttgctcttctgaacctcatgtctgtcctgggaatatttttctgggtatattgcagacagtcttgctaccaaagggatttaataaggtttctgaaagttccctaggctggccagcaaagttcccttggactacatgagactcactgggtgtgagttctggaatctgcacttttaaaagatcctaggttctaactttcatggaaacgtgtctgagcaatactagagcaggagaatagtctcctttcccagtgacacagcttctttctcctttgtgaaggtatggaagggataggtttgatgtgttctctgatgtacaaacccaagaccttcagctgaggagaccgacactgacgtgctgcctgttatggtaatgacacactcagggcaccatctccaaatgatacccagaccagtcctttcaagtctccatctcttaaagatttctgaagaaatcaaatatctattgcctgtgcagtcccatgctataaaattctaaatattttgcagtagcttttggatcttactcttgattgcactaatatgcagcacagtagagttttcgcgatgcccgtggctcttggttccagcactcactgctgggtgaccctgagaaagttccttaacatctctgtgcttcctttctccattagtaccatggaaatactactagtaatgtcatctacttcttggggcagtttagagcactgactgtgtgaagacatgtacagttgtctggacagtccctggcatatggtcagtttccaataaattctaagctgttattgttgctgttcccgcatttccctggggcatgttctggagagacagatgtcaagtctacttttgaccccttggatgatgtttagattatctcttcagctcttctgggactcaaggtctgagtctgtggggcagggggagggcacattttattagcataatgaatattcagctttccttacagggtatcgtggagcctaaatgcaatgctggagtttcatcatcatgagcttgtatggaaaatttgaatggaaatttctctaggaaattagaactctagtgacctcttcatgtaacttgtataatgcttggacaagcaagtggtcactggataatgatagcacaaaagcatataaatttttagaaataatttaaagagtgaaatttaaaggtcaaaaattattatcatatggattattctattgctattagttctattaagtccaactctcctccatcaaattgtgaagatctgaatctgatggagatatgaagctgttagcagttgaatttttattagtggtattttattttttgtatagtattcacctcgtctgttgtatcttgtgttgattacttctaccattaatgtttattgttggctaggcatgatggctcacacctataatcctagaatcttaggaggccaaggcaggaggattgcttgggcccaggagttcgagatcatcctgggcaatgtagtgagaccttgtctctacaagaataaaaaaataagctgggcatggtggttcatgcctgtattcccagctactcaggggtctgaggtgggaggattacttgagcccaggaagtcaaggctgcagtgaaccatgatcataccactacactctggcctgggcaatgggagtgagaccctgtctcaaaaaagtaaattcatttttgatctaaggaaagacttatggtactaatgttttctgagctaaatcatgagaagatggtatcaatttattcagatccagagtcagaggaaatgggcaatgggggaagagagtggagtgtggaggggaagtgaaggtgtgcggggcagggagagaggtctagggcagacaggggcaaggaataatggggaagagcagaaagcagaagttcagagatgtgagaataaaaactcatacttctggatacttactctgggccagatgtttttagtgcactctctctcttcatttatatatatacgtatcaagatatatatatatatatatatatatgtgtgtgtgtgtgtgtgtatatatatgtatatatgtatatgtatatatgtgtgtgtatatatatatgtgtgtgtgtatatatatatatatgtatagtgccacaggcatcgtgaaaactctactgtccctgcccttgcaggcaatgtgacttttggcaagttccttagtctcttaacctatgtgtctcagtttcctattctgtaataagggatgataacattagcaacacactaagtgactgttattatatatacatatttatataatgtaaaaatatagtcatatttcgataatacagggtgatgagtcaataccaggaaagcacaaagatggtctctgttccatatcaagctttctgtatgtgtttgctaccatggatgttagcagcaacatccttgtcactgtcattatgggaaatagctttggtataatattaaacaaaacaacagatgcagtattataaacacactacttgttctccaatctcataattttaaaaaacatgcatagaaaaaagcctgtaagggaatgcaccacatttgaagtgttgctctctaagtgggaaactcaatcattttgaaataacattcctttcactgttttacttgcgttttcttccttattattactcagccactgtttctctaataatttttttttttgagatggagtcctgatctgtcgcccgggctggagtgcagtggcacgatcttgtttcactgtaacctctgcttcccaggttcaagcagttttcctgcctcagcctcccgagtagctggcattacaggtatgcaccactatgcctggctaatttttgtatttttagtagagaccaggtttcaccatgttggccaggtttgtctcgaactcctgacctcatgatccgcccgactcagcctcccaaagtgctgggattacaggcgtgagccaccgcacctggccaataatttttaaaatagatgttctgaagactcattcttttaggtatcttgaggattaggggtaaaaggtgttttgatatccttatcaggaggcaaaccagtcagtgaccctcgggggcagcatttaaaacagaaggaaggtttggggtagggtagagaggggcagtgggggaggcagggtggtgtggatggaaagttagctgaagacccccaggcatcctgaaaaatgccacagtgggtacatgttgaaagaaaccaaaacacccgcatgtccataagaggaggctgctgtgctatcgagatggagatctttatgacgtctccttagacctttcctctccttcggctccggtggcgcaatttggcagcacatggccctggcaaggcgctgctgctggtgagctgtgctgaggtcaaggcccggcccacctgcagcatcatcacttcagagactggcctggggcacctgtcttggtatctggaagcctacagtttcagatcagggaaacggagaaaacacatagtgcaatagttagactcaacgctcccccagtgacgccatcagtgcaaagcgagaggcacatataggttgttgtggtcattagtttgggatgagcagggctgggttgggtcattccctgaaagaggaattgggggagtgaatgccagtgtgatctattacattactagtgcacaagtggctaagcttctgtttcctaagtttgtttttctgctaagacaatggcgtgctccgttactgtggtgagaagctgccctggcctgaggtgtgtgcgggaatgactgcacctactgatgagcattctgaagattcgccaaaagctgtgacaagggggcactgcccgcataaagctatgaaggcccctggctcttagcacccacagacccagaaagctcttcagcctggctgtgcatcatgccgtggcacctttgaggccacgggaagctttgaggccaccctcaagctaaagttctggtgcccttcagcctcctaatgcaggtcaggtggcttcccagaagctgcccactgatctgaatcagtgccaagggaatgtgtgtgtgtgtgtgtgtgtgtgtgtgtgtgtatgtgtttaacagagagggagggcgcacctgaaatagtgagagaaatcgaccagggcttgctctgtcttgcttctgacctgaggagctaactgcctttgctcattcccgcacgtaggccaagctaactatgggaggaatttagtgtagggtttaacttcaaagcaaagatgataatagtccctttcggaacccagccccgaggagatgagaagggtgtacacacaagcagcaatgttgtgtgaaaggtttatgggagcgctgtgacctgaccaaggacaaagatgttttgcaacctccctgggctcccgttgacacctagatgtctgtggtcaccattctcctcctgacctcaccctttcctgattctcccttgcctgtaaaaagaagcttgagattcatgccccttaagatggctccataggtcattagtccatcatcgtcttggcttgctggctgtctgaaataaagtcacttttctctgcccaggaggtggaggttgcagtgagccatgatcagggcactgcactccagcctgggcaatatagtgagaccctgtctcaaaaaaaaacttaatttgttgaacagtcatttgccaagcctcaactatgttctaggtactgtgctgagtgtctgggacatacaataaaaaaagacacatccccgccctcatggagtttatgtcaaattgtaggataatggtcaatctactgatcccacacaaaaaatgcaaaaattcctgccagacttcaagtaatgtcctaccacttcatgtacactgtgagactcttacagctgtatacttccatttcctttctccccagctttctgctattgttgtcttacattatatgtctacctatgtcagagccccacaatacattgttactatttgacagtcaattttcttttaaagagattagctacaagaaaaaagtcttgactgagcatggcggctcatgcctgtaatcctggcactttgggaggctgaggcaggaggattgcttgagcccagaggtttgagagaagcctgggcaacatagggagaccttttttctaaataagaaactttaaaagtttttaaaaaatcagccgggccccgtggctcatgcctataatcccagcagtttgggaggtcgaggtgggtggtttgcctgagctcaggagttcatgaccaggctgggcaacatggtgaaaccccgtctctactaaaacacaaaaaaattagccaggcgtggcggcgtgcacctgtagtcacagctacttaggaggctgaggcaggagaatcccttgaacctggaaggcggaggttgcagtgagcagagatcgtgccactgcactccagcctgggcgacagacggaaactccgtctccaaaaaataaaatcttgtactttcccacaattgttccgtgtccagtactgtgaagttctgtgtgtagatccaaatttccttctattttccttctgacccaagaacttcctttaacatggtttgtaggacaaatctgttgacagtgacttttctccccatttttgtttgtttacctgtttgtgtaaacatgtttatgtcacattcattaaaaaaaattgtgctgattagaaagttctgggttgcacagattctgatgagaagtctgatggatgactttaaatttgttcctctgtatgtagtgtgtcttcctttctttttctgccagagcattggtgttggggtttgaatcaatcttttcagtagctgaactggacttcagttgtgttgttgctgtagttattttctctctttttttttgcagcagctataaatgtgaatttattttttttttaattttttaatttttatttattatactttaagttctagggtacatgtgcacaacatgcaggtttgttacataggtatacatgcaccatgttggtgtgctgcatccattaactcgtcatttacattaggtgtatctcctaatgctatccctccctcctccctcccaccccatgacaggccccggtgtgtgatgatccccttcctgtgtccaagtgttctcattgttcaattcctacctatgagtgagaacatgcggtgtttggttttttgtccttgtgatagtttgcggagaatgatggtttccagcttcatccatgtccctacaaaggacatgaactcatccttttttatggctgcatagtattccatggtgtatatgtgccacattttcttaatccaatctatcattgatggacattttggttggttccaagtctttgctattgtgaatagtgccgcaataaacatacatgtgcatgtgtctttatagcagcatgatttataatcctttgggtatatacccagtaatgggatggctgggtcaaatggtatttctagttgtagatccttgaggaatcgccacactgtcttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggctgcctaaatgtcttcttttgagaagactttttgagaagtcttttgagaagactttgcccactttttgatggggttgtttgtttttttcttgtaaatttgtttgagttctttgtagattctggatattagccctttgtcagatgagtagattgcaaaaattttctcccattctgtaggctgcctattcacgctgatggtagtttcttttgctgtgcagaagctcttgagtttaattagatcccatttgtcaattttggcttttgttgccattgcttttggtgttttagacatgaagtccttgcccatgcctatgtcctgaaaggtattgcctaggttttcttctagggttttaatggttttaggtctaacatttaagtctttaatccatcttgaattaatttttgtataaggtgtaaggaagggatccagtttcagctttctgcatatggctagccagttttcccagcaccatttattcaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactatagccttgtagtatatatagtttgaagtcaggtagcgtgatgcctccagatttgttcttttggcttagggttgtcttggcaatgcaggcccttttttggttccatatgaactttaaagtagttttttccaattctgtgaagaaagtcattggtagcttgatggggatggcattgattctataaattaccttgggcagtatggccattttcacgatattgactcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtggatgggagttcactcatgatttggctctctgtctgtctgctattggtgtataagaatgcttgtgatttttgcacattgatttttgtatcctgagactttgctgatgttgcttatcagcttaaggagattttgggctgagacgatggggttttctaaatatacaatcatgtcatctgcaaatagggacaatttgacttcctcttttcctaattgaataccctttatttctttctcctgcctggttgccctggccagaacttccgacactatgttgaataggagtggtgagagagggcatccctgtcttgtgccagttttcaaagggaatgcttccaggttttgcccattcagtatgatattggctgtgggtttgtcataaatagctcttattattttgagatacgtcccgtcaatacctaatttattgagagtttttagcatgaaggctgttgaattttgtcaaaggccttttctgcatctattgagataatcatgtggtttttgtgtttggttctgtttatatgctggattacatttattgactttcgtatgttaaaccagccttgcatcccagggatgaagcccacttgatcgtggtggataagctttttgatgtgctgctggattcggtttgccagtattttactgaggatttttgcatcaatgttcatcagggatattggtctaaaagctgtagatattttcaatataacacaatacctcagattcagggtacaagatatcagtatgcaaaaatcaattgtattacttctttgtttttatttgataaattggcataataattgtacatatacatggggcaagtagtgatatttccatacatatgatgtatggtgatcaaagcagagtaattagcatatggattgtctcaaacattcatcatttctttgtgttgggaatattcaatgtcctcctaactatttgaaactatataatatattatttgtttactttttcaagacagagtctcactctgtcacccaggctggagtgcagtggcacgatctcagctcactgcaacctccgcttcccaagctcaagcggttctcctgtctcaggatcccgagtagctgggattacaggcaaccaccaccacgcctggctaatttttgtatttttagtagagacggtgttttgccatgtcgaccaggctggtctcaaactcctgacctcagatgatccgcccgcctcagtctccctaagtgctgggattacaggtgtgagccaccatgcccggcctatataatatattatcgttcattatagttatcccacaatgctgtggaacactataacttacttctcctatcaaactgtaattttgtatcctttaacaaatctctctctatctccaccaccccttaccctttccagcctctagtatcctctgttctactttttatttctatgagattagcattttttagcttccacatatgaatgacaacatgtggtgtttaagtctctgttcctggcttatttcacttaacataaagtcctccacttccacccaagattgctcagaatgacagaatttcattcctttttagggctgaaaagtattgcattgtgtacgtgtaccacattttcttcatccgttcatctagactgattccatagcatggctattgtgcatagtgctataatcaatgtgggagtgcagatgtctctttgatatgctgatttcctatcccttgaataaatgcccagtagtgggattgctggatcatatggtggttctattgtagtttttggaggaacctcccttctgttctccatagtgtctctactagtttaaattctcaccaatagggtatgacagttcccttttctctgcatccttgccagtgtttgttatttttcgtctttttgagaataggcattctagctgagtgagattgccagcatttgtttgtttgtttgtttgttttgtctttttgataacaggtattgtaactgtgtgagacgataactcattgtggttttactgttatttcttttcttttctggagacagggtctcactatgttgcccaggctggtcttgaagtcctgagctcaagcagtcctcctcccttggcttcctaagtagctgggactacaggcctgctccatcccagccagctctcattgtggttttgatttgcatttccctgatgattagcgatgctgaacattttttcatacatttcttggccatttgtaggtcttcctttgagaaacatctattcagataatttccctatttgagcttggatgggttttttggctgttgagatgtttgacttccttgtatatcatggttattaacaccctgtctaatgaatagtttgcaaatcttttcaatcttttgtaaataaacaaatacgggattttatttttttaattatatttttttgagacaggattgtgctctgtcacccaggttggagtgcggtggcgcgatcaaggctcactgcagcctcaacctcccaggcccaaaccttcctcccacctcagcctcctgagtacctgggattccaggtgctcacaaccctgcccagctcatttttaatttttttttgtaaagacagggtctcgctatgttgcccagactggtcttgaactcctggcctcaactgatcctcccacttcagcctctgaagagctgggattacaggagtgagccatcgtgcccagcctaaatatgggattttaggcattaagcagggacaggtgtttgggtgagcgtagctaagagctgggttcttcagtcagagagcatcccaccaggcattgattaagcccggactgtgttcagagcgctggaggaaatgctgaagatgcgacactgggctcctgtggtcctgcgggagtgcacgtccaccagggaatcagagatgggccactgagtgtgtccgccaggaggatcaggcctaccggccaggcccacctgggcctcagtccccgaattccacagccttacagctgttttcatccatgagcaaatagccctgccctagggctggtctagaggagatggggcagggagatgtctgggctccttccgtttgcacaaagccctgcaagaagcatggataccctcgtgtgctgtctcttgtaaagcagaatcaggcatttagaggtagggagtggggtcggggggacgggtctctcatggcacagggaggataactggggagggacagcagcacccctcagtgtcagctcttggtctgtgccacggatcctcagcacagcacggccagctacttcaggctccactttagctgcctctgcttcactcccttgcgaaagatctgcaggtgcccttctgttcagggccacagagggcagagagaagccaggtggccgccgtgcctcctgagtgcacttgcccaggaggctgaagcagacttgctcagggcggatgaagagggtgtggacaagcagtcccaaggttgggggaagcttccagcactttcgtaagcagcacaggttcatgctcttattccaccggggcagagacaccccttccccacaccaggacagcagcacctcagcaggagggcagctggggccttaggggcacagggttccacctcatgatggcatgaaccctccaaacctagaatggatccccattttgatgggtaaagggctcccctgtgtgcctgggccagctcctgccctcctggatgtggcctaggcccagaaacagcctctgagggcagaaaccggggtctcccttcgcctggaaaacaaaaggttattcggctgcctgggcccgggtcctgagatcgaggctaactccgtgaggacagaaggtgtccagaaatgctctccctaatcctcaatccctcccccacctcattgctccctttgactctgtctgtctctgtctccctgtgtctccatgtctgcctcatgagcctgggtgatctcttgctgtgactgcatctgacacgtgtcctgtaccaagtgactttttaggtgtctccaacgcaagatgtcattctgctgagctttttcaggctctgtgcccagattctgaggcctctgaccaatttggagggtagcgtcccaggtcggcaggtctctgagctgtggagggcttgtgtctggggtgacagtcctctgggctgatcagggttctctctcccagcatgtgaggtgtctgatctgctttaggtattgtgtctagaatgcaaggcatgggagcagttctgatttcaggaagtagggtttgagctctcccgagtgtctgtgtcaatgataggacacaatagcgccccttggggctccatatcctaggttgtgagaacactgaggttattccaaactcacgaaaggtgtctgatccttttggggtcctgcgtcctgagtgtgtcctccctacccggttatgagtctgcaccgcaggggttgaggctgctgacatgttgaggagttgctgtgtctcaggttgtaaactctgtgctgtgtgggaatggtgtgtcccacactctgaggtctcctaggtgtttgttgcagggaacattgtgcccaaggcctctgtgttccctgtcccggtcccctcaactgtttctgtgtccgcatctcagggtgtgcgcactgtggttttgtgggcttctgggtccgggctgtgaggtccgtgaggtaatccgttttctacatcacaggttctaaagttgctcacacgcacgtgggtctgaattttagaatctgatgtctctgagcaggtttagtgtctgtgtcctccttcactgagttcttggaggggtctgagttctgcgaactgttcagtgttgtgtgtccagggttgaggtctctgagctgcttgttcctgggttgttgtctgggttttctatgtcactggggtctcttgggctttgtgacccagcctgtgaggtccctgaggtatctgagagtgtgtgtgtccaggataggacgtttcagagctggtaggagatgtatgttttggagggaggcctgttctgtctttggttccgtgttccagggattgaaacgtctgagctctttgggagatcatctcaagcatgagagacactgtcacatagcaaagttcagacatgagttgtttgtgaccttctcctgatatttgggtctcaccctgtacagtcagtgagaggttgtcttgagttgactttcccagactcgtccactccagcctgccacagccacgcttacttatctagacccctgagtttacacggccagcttccttcacagctgcccctggggttggagtcatgcgactgctttgagagtcacaggtccccctcagcaccacttgtggagatctcactgtgcggaggagtttcttctgtgtctctgataaaagacacagagcagggaccctctctctcagcgatgaacaggacctgcccatgtgttcctgggtcgtgtggtctgtctcctgcaagatgtcactgacacccagaaaataacctggacacaacatccctcttgcagctctcccagaacacatgcatcaaacccgggatcccctgtgccctggtgggatggcaggagtctctagctgtttggatcatcttcccaaaccttaacttcacctttacatgatgaggatctacagagcggcatctcagccctttcctgcaaacgcacggtgcttctgaatgcagaattcggggctagggaagggaggggacacaggtagatgccatctgtggtcagggggaggtgtgggcccgagaccgtctcagctgaaatgtaggagtaatgggcacagaccattcaagagaaatgtgtgttgggctgaagaaagtagaaactacctccagagtatctcctccatctctaagacatgcacggtttaattctgttattttgtgaggctctttgcaccatgacacaagcatgcatagagggctccatcatacaggggagaacgagaccctgaatggtctcacagtctagtgggggaggcatatgtgttccttcaggcaacaaatatgtatgaaagtcttctacgtgccaggcactgcttgaggtgtagggatacctcagggaagcaaatcaacagaaatccctgccctggatctgacattccccgaagaggacgtggtaggtggcagacagcaaaccctccacaagggaatctaggaaacgttagaagttatgaaccaaaacgtacccgagacaggtctcaatcaatttagaagtttattttgccaaggttaaggacgtgcccctgacacaacctcaggaggtcctgacgaaacatccccaaggtcgtcagggtacagcttcgctttatacactttagggagacataagacatcaatcaatgcatgtacgacatacattgattccttctgaaaaggcgggacaactacaagttggcgggcggtggaggggcggtggggtcttacaggtcataagtggattcaaagattttctgattggcaattgcttgagtttatctaaagacctccaatccataggagggagtgtctgggttaagataaggggttgtggagatcaaggttcttattatgccaatgaagtcccgaggcagccggcttcagagagaatagactgtaaatatttcttatcagaccttaaaagttgctggactcttgggaactaattctctcctagaccaggaaaaagacctggaaagggaaagggattctctacagaatgtagacttcctcacaagagatggctttgtaggcctatttcaaaatgtgtcaaagaaatgtattgttggatgaaacactttgacttctttcagggcctatttgttatgtgatgctatactagtcaggctggaacttggtgtcttattgccacagtcttaagatctctcccttaacataaatgctggtcagttgtgcctgaattccatagggagaagggtgtaatgacgcatgtctgacccacccttcccatcatggcctgaactactttttcaggctaactttggaaaagctttggccgagaggaagggtccattcagatggttggggagtggggcttagaattttatatttagtttacaaagatgatgggggctgtgttaaaaagaaaaaatatacagatcacagtacagggattgggaattgggggaggcactgggttagctgcaggtaaattataacagagtgactagggtaggctgggttgagaaggtgacaatttgacaaagatgtgaagggggaggagtcagtcaagcagatatctgtggtgaaggccttccagacagagggagcagttggaaaaaagtcagaggctgagtcgttccaacatggcgcagatgccacaaggacactagcacaccagcaggaagctgaacagaaggctggaggtgccacggtgacaaggacgggatcctgtcaggccaggtaagcttctgctctgccagtgacacggaaagggacaatgaagggccacagatacagaaagcatgtctgtgcagcctgcagagttcaggtgaaggagggacccaggcaggagcagtcagaaccaggagggcttaggcaagagacaggacaggcaaaggcactgatgcagcccacccagacttgacagacgcgttcatccaggtgttcatgtccttgtcactgtggacatctgtgttgcagccacagaaccacatactcgattaggacgcctgaacccaatcaatagtcgtttttccctacagaccctgggggaggcccacatgcacttgccctagggtactctgacattttggcactgcagtcccactgggaggccacatggagtaacatactggccaagacatatttaaaaattctggcagggtgcggtggctcacacctgtaatcccaggacttggggagggcaaggcaggcagatcacttgaggtcaggagttcaagaacagcctggccaatatggtgaagccccatttctactaaaaatccaaaaaaaaaataatcccgggtgcagtgacgcacacctgtaatcccagctacttgggtggctgaggcacaagaatcacttgatcccaggaggtggaggatgcagtgagctgagattgtgccactgcactccagcctgggtgacagagctagtctctatctaaaataaacaaataattttgtagcctcttttactaggagttctggaattagggaagagaggaaaggtacaaccctcctcccgaactccaggggaggagaatctcattgcacagatgtcctctgttcactcgattctcctggagcatttctaaggcacacagagctgctaccatcatagccattactgaccaagtactctgggtgaaattcctttattaactgaataaacttgttctgaagtgctgaccggacactctggggacagggggaggtttcggctgtatccttgctggcagatgacccccacacttggggggtaaggagagccatggcagaattcaacccacggtcccctaggagtacacaggagaccaccctaccctcacctgagggatgtgtgtgtgcaagggttgggtcagggcagactcttcagaagaggggaggtttgtgcggcaggcactttgattctgcacagcttacagtccagagagccgaagaacaagaggaactagattcccattctcagtctgttgatttccacaccacatttggagtctgatcaactccacagctgtgttgcagccgctaacgctgcctctgctctgtttgcctctagattcttcttatctgttaaataaagtgaggctgatggagatgtaatttagggcgggggtggattgcaagtgtctctgtgatagggcaaagcgcctcccggtggaggcgcagaagctaaactcgactggtagctgtgaggcaagggacgccagggcagctcctgtggactgtgttagaacttttcagggtggctttgccctgccaggggcctggatctcacagggggacgtcgtgttaggaccaagctgactgtcccatcacagaataatatctgcagctcagcatggggagcataagcaaagtacgttgtcgtgagtttaaagaggcctggctttggagtctgacagaacccgcgtgtgagtcccagatccagccttttctgcctcagtgccctgacctctttcagcttggttccttatctgtagatgggagtttgatacttacctctctgggtctttgggaaatcaacactgtacatgagtagcacacagtaggtcctcaacaaccaggctccagggagagagagccattcacactgtgccatgttagaggcacatcagtgtgcaggccagcgtgccaggacagtgggagtccagtctaccctccagccagggtttgggcttgggctgatggtggcaggaccagggccatttccatcttttctcttttattgtccatatgtccaaagcagacacttccattcatattcaggtgtgcaatgctaggagctgaaataacaggctgtagtgaatgaagcgaagcctcacagttcactctatggcaggaagaaccagctgtgaggcaggtcctcagcccacatcacttcatggtactgaacctggggccacaattccaaactccatgttcacacatgatgagtctataggaatgaaggagagatctatgttgtgtatctttattattatgttttattgtatatatttaaggtataaaacatgttgttatacacacacacacacacacagtgaaataattgctacagtcaggcaaatgaacctgtcaccttcctcagttaccttcctgcatcctatttttgcaagtaaacttttcctaaaaaccctactctcacgtgacattccagttggttggcccattgggggaattttcatgaatctccatcatgtgctattcagtaaaaatatcaaacccactaagcatgccttttcatccagttgctccctaggtaaagtataatttgctctccttcacttgagagctgaaggtaaggagcaatcaggcagcggttgatggagcaagtgcaggccagacagagggaagggcggttgtgaggcggcagacacgagagagagacagcgagagagcgagcgtgcacgctagacagagagaggcctggtagtagctggggcctgatacccctaatccaggaggctggactttatcctaagggcagcaggcagccctagtagaatttgaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaaaaaaaaaaaaaaaaatgaaacagcacgtgtcggttctcagcggcgcgccctagctcaaaactccagccaatcacaggagaagtcggccgcctcccaaccctccagcccagttcccacgtccctcgcccgggaagtcacgtccgctacagggagtgtcttcccatggcctccggaagcattcggcagtccacaagccacgcttcagagaagccgctccgggaacgccgcggcgcacctccggaagggatgacctccacgccttctcccctcgcagtccacccgagcggcgtgggtcgcgagaagccacccaaccgctccgtcttccggctccggcggtccgcggcagccaatcaaaggttcagtttctcagcggcgtcgcatccctgtgacgtgagcacatcctcgccggcgcccccttccgcgctgcggcgcctctagcccgccggagggcggctcctctcgatggtcttaacccttcaattacgagcgggcggcgctgcgtttccagggcagaggaaacgaggcgccgcgttggcgcttggacggcgggaaccggctccggagcgagaacgcgcgtgagagagcccgagagagacggagagcgagcgagcgcgcgggagagactgagagcggggggtgggagagagacttccagagagacagagcgagaggccgagacggaggctgtccctagcacaggccagggtgtcttgggactcgaatccctgggttgggctggccgggagtggggctttcgaaggaagcgggtgattttccacgtcgtccatatctccccggtgtgggaatggcggtcgtgcactctgggggtggcgttgttctcgttccctacttgggggtggcctttttcagcggagaaagagaatgccgcgggcattggtagccggcgggactacacttgggctaggatcagtgttcagcgggttcagaaatcaccgtgtccttggcatcacctccctccccacctcctctcccatcgcacagcaggagacagtgactggagggttttcaaggaggactgcattgcccctattgaaacaaaccgtccgacaaaccctttctccgacgtgtgacagagggacggtcgtaatgtgaaatacgactagacatgcgtttaatgggcggtgtgattgctgcattcgtgcgcaatgaatggtccaggccatttgtgtccagtagccgcacaagctgcagggtctcatgtttagagagggagggcctctccgccgtccaccttgctggagtacaggcgaccctgggcggtagccctctccgccatcagaaatgtggtgctctgagtagccacagattcccatctgcatctccaataccatttccctctactcactgacccgttgggtgcgttggatttgtgcgtgggtgtgagggtagtttggtgtgtttgcttgcaaatggaaaagcgaatggccttggttggctgagcttatcagggcactagcagtggagagagaaaggactactgtattcttaggagcagaatctcaacaacttcctataaaacgggcagtgtgtcttacctggaatgctttggcatttaataaaatgtcctgtgaatacttttcatagggaagcactttgtttttactgtttctggttggacagtggttacatttcaaatcgtagttcagaattcgtgaaatacccaaattaaatctctacgtggcagtaatccattttctttccttggtgtgtggttggaagattaatttgagataagtgttcagttctgggctgggcagtcgtgccgggcacgggaaattcaggttctttaagggaaaggcctgatgtgctaagacgaaatctataccgtgtgtagccgcttatgagaatatgaaactaaggagagccacaggtaagtatacgtctatgaatgcgaattaaaacgggtgacaatataaagagagattggtgtcacaaatggtggagtgacttttgtatttcagcagacctcagtgagaaatggtcaccaccactccctagatgtgtgaccttgagtgagttgcttaacctctctgatcctgttacctcatctgcaactggggatgagaatatatatcatagcatgccctgggagaagctgttcctgaccacctgggctatggtgattttgacttcctctgtgtcagaagtacccccgtctcatgcctgccatagttgtctttttgttttgttttgtgatttcagatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttgggtgagtctaggcaagctccattctcgccagagcggacttgctccttgtcttcctcttgctgctctggccactcttcttggtccctcccctgttccctccccggactcccggttgtactcccgctgcttttctgtgtactcacctgctgggagacccctgatgccagcaccacgcttcactgctgtcttcattttcttctttctttcttgaaagtgggcattgctggctttactgactacctgttcttttgttacaaagctgctaaaaattgtatctcttccgctccagacccagtaggatagagatgatctgtgtaggcatcaaaaatgtagaacatctgcaagtcatgtgtaggacagactctttcctcaatctgtgtggcgttgcgtggctaggagttagattcctttgccatgacatggcacaagactaggagcacggttttcagcacccagagaacttgcacagaccttagacattttgctgtaggattttgccacttctagaaaaaagtccatgtggccgggcgtggtggctcacgcctgtaatctcagcactttgggaagccgacgtgggcagatcacaaggtcaggagttcgcggccagcctggccaccgtggtgaaaccctgtctctactaaaaatacaaatgtgagccgggtgtggtggcgggtgcttgtaatcccagctactccggaggctgaggcaggagaattgctttaaaccaggagacggaggttgcagtgagctgagatcatgccactgcactccagcctgggcgacacagtgagactgtctcaaaaaaaaaaaaaaaagtccatatttaattgggattattaaatgaaatctgtatctttaaactgaaataaatgcattttattatctcatattattgtggaagattgaaaaaagcatcacatgggactggcttaattttgaaaagaaacacaaagctcttcctggcgctcatctgcagggtgtagtctggattcacttgcttagctgttctctttctccttccgcacaggagaattgaagcgaatgagagtggggagtgtgagaggtgcgtttggtgcagcatttctggcatgggaacagaactggccaggaggaagtgacggtaaggattcgcagcattgcacccgatccccgggcagctgtggacatgcgggtcagcccctaggactctgctgtctgaactcttccctcaggattactttctcgcttaggtatcaggggaggctgaacacccagagaggcaatgccaccaggggtgtgttcatctgcagtcagggagacctgggagggaattctgtccctgagtggttgtgtgatctgagggaagttacttgacctctccatgcaggaatttctgcctttgcaacgtgggaaaatatggattctgcagggttgacttgacattctcagtgagatgtttatcacgggccccacatccttcttgtttcatttgatagatatttgtgaatgtccactgggctcaaggctctgtgatgggtgaacaagacaaagtccctggcctctgtcagctcctgggctagtgggttgacagagaaataaccatctgttgacagctgagtgggattggggctgggacaggggaaatacagggcgttttaggagcttggagaaggcttcctgggagaagtgctatctcagctgagtcatgcagggtgaatgagaggtgaaagtcttgccaagggccatggcagtcccaaactacaggcacccatcactatacccggctaatttttatttttagtagagatggggtttcaccccggtggccaggctgctctcgaactgctgacctcaagtgatccacccgcctcagcctcccgaagcagggattacaggcgtgagccactgtgcccagcgtgattgtaaatgttaatcatgtccacaaataccttcccagcaacaactagagtagcatttgaccaaaagggaccaggcaccaagcctggccgagttgaccgataaaaccatcacagtgagggattggtacccagagacatcacctctcatgctgaaggtctgaccggtaaactgtctgggttccctgtctccagtagtccttctctctcttcggtagctgcatgacatgatgcaggaaacttgaggctgtggtgtttcatgcagagatttttgatacaaggtcttttacctgggggcaagtgcctgttgaagaaatgacattggtgagatgatgaaggaagggaagtcacatgtattgctgcagctgctcccctccgcacacacaacggacttctctaggcctcactgtccttaatgcctctgtcagggatcatgagcaactccatgggtgtggtttgagaatctctggatgaacctacacataggacggtaaaatgtttcatttcacaaaattgctggagggagaaagagagaaaagagagcgatgactatgcaggccggttgtcagttgatgtctccagaatcttcctatttcttttttttctttttcttttttttttttttttttttttttttttgagacagagtcttgctccgttgcccagactggagtgcagtggtgcaatctcggcttactgcaacctccgcctcctgggttcaagtgattctcctgcctcaacctctctattacctgggattacaggtgcccaccaccacacccagctaatttttttgtattttccgtagagatggcgtttcgccatgttggccaggctggtctcaaacccctgacctcaggtgatctgcctgcctcggccttccaaagtgctgggattgcaggcatgagccaccacacccggctcacatttcttctcataaaagtgtttctggctgggaacagtggctcacgcctataatcccagcactctgggaggctgaggcatgcagatcatgtggagctcaggagttccagaccagcctaggcaacatggcaaaaccccgtctctacaaaaaatacaaaaattagccgggcatggtggctcacgcctgtagtgcaagctgctcaggcgtctgagactggaggatcccttgagcccaggaagcagaggtttcaatgagccgaggttttgccactgcacaccagactaggtaacagagcgagtccctgcctcaaacaaacaaacaaaacagcaaaagaaacgtggggggtgggggtcgtaaggtcttttctctctctgagaattggctttctacatgtagaaatagatcctgagagagtccttgtgacacatgagaattggctgggagataattgggttaagatcattttccaaacgtttcacacattaactgtttgtgtcagatagtggtggcccaaaggatgtcagggaactaactcgtaggaaagatagattgcaatttctgaaaagttaagaactctttctgggatgtgtgtgtgtgtgtgtttatatatgtttgtgttcagtacatattcaaactgttcctgttacggttctgtctttcttgccccagtgtgggctgatagccacgatttggtgaataaacattcagaggaccagtatcctctgaagaaaactagtgaattcttggtttccacgtttgtcaaaagaatagagcctgggaggctgatctaaagtttccatttagcatttaatgtcaatttttggttgcactcatccaagatgtatttatcaaaacagtacagagagatacccttatcgcaaaatatgccgttgggtttttccacttaacctacagcaagattgacttttttccctcaggagtacagttctgtgagctttgacacgggcatacattcttgtcaccaccaccacagtcgggatccagaacagtcccatcaccgcaggacactccctggaactgccccattgcggttaccccttcttcatccatcatccctggtgtaaagtgatctgtttccttccctctagttttgtcttggggagagtgttatgtcaatgacaccatacagtttgtggccttgtgaggcgggcttccttcttttggcccgatgaacatctcggatgagtgtcagatgcctctgtcacaggctgttgttttttcatgaaggcagtttcacggtgtggaagaccacaggtgttcagccatccttctactgaatgacattttcctctgtccagtgtggggcagtttcgcatcgagctgcttttacaattcagtgcgggcttttttgtgaacctaagttttcatttctctagggtagatacccaggagtgggatggctgggtcctatggtaaacatctgtttgacttacaagaaactgccaaactgcttctcaaagttgctgtgctatttcgccctcccagctgcaaagtgtgagagttccagtcacccaacatgttctcgcttggccttgccagtctccatggtgttaatttgcattcccctaatgctgaatgatgttaaatatggtttcttgcgctcccattcaagtctttcccccattttctagttggggtgttgattttcttattgtggagttttgaaaacgcgccatgtgttttggatataagatctgtcaggttggtgattctcaaacatttcctcctagtggtgcagctttgattttcattctctgaacacactggctcttacacagccaaagttgtgttgtattgtattgtgttgtattgtgttgtattgtattgtattgtatcgtatcgtatcgtatagtatcgtatagtatcgtatcgtatcctattctattctatctatcctattctattctgttctatttatttatttagagacaggggctcgctatgtcgcccagactggagggcagtggctcgatctcggctcactgcagcctctgcctcctgggtcgagcaattctcctgcctcagcctccccagtagctggggactacaggtatgtcccaccatgccaggtaatttttgtattttttggtagagacagggtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatctttcctttccatggatcatgcatctcaggtcatgtcctagcctcccctcacaaagatgtcctcctacggtttctaccaaaagtcatagtattgaactttggcgtgtaggtctctgaaccctttttccttaattgcgtgtaaaggttgaggttgaggtgcatctttttgcgtaaggataggccacctcatgtattgaaaagcttatcccttctccattggattccctctcacacccatgtcaaaactcattggacacatttctatggatggattcatggactctattttattccatggatctactcgtctacccctgtaagccagcaatctcgattattacagctttagagcaaatctgaaaatctgataatatcatctctctaaaataccttctgctttttgaaacatcagatattccacgtgaattgtagaatctgcttgtttatgcatgcaaatgtccctcaaggattctgattggcaggcactgcattcattctacagatcaagttggggacaatggactgttaacttttttgggtctttaaatatgggaacacattgtttctctccatttaactaaatcttctttgattttttcattaccgtttaatagttttgggcatacagaccccgtccacgtattttagctttatacataaccattgcattgtgtttgtagcttttgtaaaacagtattatttcttaaatttaggtttccagttacgcataggattgttttccgtgtgttgagtttctctcctgtattgctgctaagctctcattaatgagcactaagctcttattagctctgagagtctgggggagatacactggttgtttcatgtagacgatcacaggacccatgaaaaggagtactttggtttcttgctttctccggtgtgtgccgtgattcttctggcattatagcactgactgggcctcagcgtgacgttgaatagctgtggtgagagtggacgtccttgcctggttcgcatccttaggcagaaagcatccagtcgttgaccattaagtggcttgttagttgtaggtttgactgtacacgccctttttcaggttgaggaagttgtcttgtgttcctagtgtgctagagcttttatatcaccagtggactttgaatcttatcaaagggtttttctgcatagcttgatgtgatcctgtcatttttgttcttcatctgatctctcaatctgtgggttacattgattgattttcaggtgtgggaagaacaacccttgcattcccgctataaaacccacttgatcgtggcttattattcttctcacatattgctcaattcaaactgcaaggttttgttgaatactttggtgcctgtactaggaaagaatactggtctgtccttttcttggtatccctgtggtgctggcctcataaaatcagtggggcgcattccctctgctttgtttcctagaagaagttgtgtaagttggtgatatttcttcattaaacgtttggtagacttggccagtgaaactgtcttggcccagagatctttttgcaaatgtgtttgcctgtgaattcaacttctttaaaacatataggactgtgcacacagttcagtgtttgaaatccatcctgtgtgagtttccgtagcttgtggttttcaagtatgtgctacatttcctctgacctgtggaatgtgaatctgtagagttgcgtgtattcttaccatattgacccttttatgttttctgggtctggagtgaaatctcttcttgcattcctgatattggtaacttgtttctttgccctcttttttcccagccagtcctgccacgggtgtatcaatttcattgatcacttcaaagaaccagctttttttttttttttttttcctggattaattgaattcatctatgtgtttttctgtttgaagtctcctgggggtttatgcttctgttgtttagcaaaataaattcttatccacactaggaatttggaaacgatttccataggcatgagcagccttttcgactagatgcaaacccagtggtcaggaaggcgaacatacaaaagggtgtgtccccatggtgcaaacgcttacagttgagtaaaagtctcccttgtgagtggatgaaaatgaacgctcatgggcagagcacctgtgagtcacacattgattattctacaaatgatgcttgggaaggggttggaaaatgtcagcagagaattgacatcgtcgaactgcattgcatccttttgcaccccgtgtcacgtggatgcattaattggtatcatttgtaaatcctttattagatggcattaatattctaagctggtgagatgtatgatctcacgtcatcctcagaagaagcctaggacagggtctctctataatccccattctacacacaggaagtggagggacagagaggttgagtaagatgaataattctgtgttttcttgtcttatcaccttgcgttgcagtctgggttctgcccgcacacattcctcgccaccttcttggtgtctgagaacctccagcttcacctccttttctggacccgagggcctggcggagcttccagctgggacca

SEQ ID NO: 3416 - DNA, 786 bp, human
atatcctcaaattccttgcagcagaaccccacttgaatggcaccaaccttgacttccaaatggaacagtacattacagaaggaaaagtggtggcatctacatcataaatctgaaaaggacctggaagaagattctgccattgttgccattgaaaaccagactgatgctagtattatatcttccaggaatactggccagtgggctgtgctaaagtttgctgtttccactggggccactcttattgctgggcacttcactcctggaactttcactaatcagatccaggcagccttccaggagccacgtctgctggtggttactgatcccagggctgaccactaacctctcacagaggcatcttatattaacttgcctatcattgctctgggtcacacagagtctcccctgcactgtgtggacactgccatcccatgcaacaacccaggagttccctcagggggtctagtgtaatggatgctggcccaggaggttctgcacgtgcgttgtaccacctcccgtgaacacccatgggagttatgcctgatctctatttctgcagagatcctgaaaagattgaaaacgaagagcaggctgctggagaaaaggctgtgaccaaggaggaacttcagggtgaatggactgcgccagctcctgagtctactgctattcaacctgagggtacagactggtctgaaggcatgcaggtgccctttgtacctattcaataattctctactcaagtttggagcactcagcctgccactggaggctggtctgtagcagtca

SEQ ID NO: 3417 - DNA, 88464 bp, human
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaagtaaggaatgtgtgtttgtacccccggctcttccctctagatccctctccaacttgtccagctgatagagtaagaagccagtgtctggttccgtgtcttcctctcctgtcccaacccgccaggagaagccaggtccccctcatccagccgacaccccttccctggccaccccaggctgggttggccagatgagtgcaggcgtctcttctttcccggtaccgcggccagcgagggactagagcagtcatcgccgcctcccccgcctccacttcttcaacccctagctgcatccttgccagaagataggttttcatttatttatttattttgggtatgctggttggaatttttatggtcggcgagggtgtctactcagagccccaggggagagaaagccccccacccccgcctttttttttttttcctttttctttttgcctgatcttttctcctctggccgcctcagctccatcccttaccaaagaggcaggtggggaccagaatggctgctggaggctgagacatccctctgaagggaactgcagcacattctggccggggggagcaaagatgggggagcaaagatggaggccaagcccttggctagttcctcaaagtccaccccctctccacccttcaagaaaaacaacacccatttaaagagccctaccgggaagggaagtctagattgcccctctgctggatcggttccagttcctgcactggggtctgtgtgtctatttgggacaccttggcactatctcttgggttggtgggacatgggctgggtccactttttctgtgtagataccatggtgagctgattgggttacatgtatcaggctgagagagtcaagggcgtgcagactcccaaggctgccctaaaggctcccttatttcttttctgccgtattcgaaggaacactgagctgggagttgggagacctgagttccccttccagctctgctgcagattggctttgtgaccttgactgagtctctttctctcttaggccatcagttcccccgtatctttttaaatggcaaggtctgccttggatgatcttgaagtacccctccagctcagatttgatggttctatgtttaatccagccacactacagagcaagtctgaagtcctgtagcgaatggacaggcttccccctcctctcactgctcagctggtcctaccatgtgccacaaccagtggagtgtctcttggaggctgggctgggggtggggaaaccttctgcctcaggaaatctgccgggagacagctctctgcaactcccccgtggtgaggcagcaggctggggtgctgggttgagatggctgggccccaggagcagcagctgtagcttgagggctcggctgggctccactgcagcacaccctaagctgaattttagtgtggactgcccctgaggagtctgggggcaaaggaaatgggctttcctgcccaggcagggctgctgcgagctcagtccgggaggaccgactgtgtgccttggggcgccacactggaagagggacagaggtagaccaaggtccattcagggagggtcatggtgggccgggggcagaggaagactgcatggggtatggtcgagcctggctgcagaagacttttctagaggggtcaggcctgtgacagagggagcggactcattatgtgtggcttcagtgagcagaacccgaaacagtgggaacatttgagatagattaggaagaactttccaacctggcattctggtggtgcagtggactgcctcgagaggtggaggtgggagctggatggacctggagctctcagcggagctcgggtgggagtctgggagaactggaggaagcatgattcctgaatcaggtagaaagcccagtgaaatgacctgggtcgtccccagttatgggattccatgactctggctctccaccctgcagacattggtctgaatctcttggctgactggttgcctgtttgctcctgagctccatgtttctgctatccgtgcaggcctacctcttggtccttccctctttttgtgaacccccccaggttgcttgttgcgtttccttgctttgcatttcctactggattaataaaggggtttaggtagtactttaagtttctctcctgaccatatattaactatttgcacacccattattacctctttttgacttcacaacaagccttctgcagtgagtgttggcaactgcattttagagatggggaaactgaggctccaagatgaagggacctcactcaaggttaccctactagttgctaatggagctgggactagaacccaagtcttcctgtctccaaggcctggtatttttttctctagagctctccaacccacaggagtctcttagcctcaggacctggcctggcactgagctaggagaggccaggagagccttaggtctctagaggatttgagcaggaggagatgagtctgggatgagtggggagttgacagcggcagggaagaaggctctgtctccctcctttccactctccctcctggcctggcatcaggagggcctgttgatgcagtagccattgctgtcactgctgctactgcaagcgactcccctgctaggtctgttctgggtttgtaaggagtgggtgagaagccgctggaagcgagggcaggcagggtgggagtttagcagcagaggctgcagcattgggggaggctaggtagagcgggtacaggctgggctctcttggtccccaggctccccctggtggaggaagaggggagagtggtgcctgggccgagctgcagcttgttgggggggccccgctgtgcctagggactttctttagtcctcccaatgatcccgtgcttctgtcaccacgatccacattttacagcagaagaaactgggggatcagagaagtgaagcccaccagaggttacattactcataagacagactcccaatcctgtgaactttccctctactgcattggacatcagctgtcatgtccacccccatccatgtcatccacccaggattcccatatcctcctgcaccgtcccctctggacaggttccaggatgccagtatcccttctgctgtgctcagggtgtggcctttctagtgcagatagagtgagatgcgtccctgtctccttttggtcctgggtcctctgtacgcgaaggttttgtttgcttgctttttagtcgttggtcctgactaatgctcaggtctttttacctggaattgtccacatacccccccaagcctggttgattagagaatagctctgcttttgttgttgatcttggcttggcccccttgcagtcctgccacctagagtgatatataggagtgctaggggcccctgctgagttgctccacgctgaagagctgcgtttcccacgctctttgcatgggcccagctccggctctgctgtaggcggtggtgggctgaagctggtatggtggcaactctccttcctttacccccacccccatccaccctgcaagctggcttacacttggagatagcaactagaggggctggcctggtggtgttttttttctttttcttttttttttttttttggttttggtttgtttttgggacaggggtcttgctctgctgctcaggctggagtgcagtgttgcgaacatagcttactcaagtgagttcaggagtttgaggctgcagtgagcaataattgcaaaaaaggaacaccaggctggcccttctagttgctatccgcccaattcttttaagcagagacggggtctctctgtgttgcccagactggtctcaaactcctgggctcaagcggtcctccctccttggcgtcccaaagtgctgagccaccacgcccggcccaacgtggtattcttgacagctagggcagtgtatggtctaccacatgctgtcgtctgcttgcagtgggatgtcagcatgctccccgcaggggctaaggccactgagagacagcacgtgagacagtgagcccagggagaggctcagggaagtctctcctttggggtcttgggtacttttcccagggggtgtctctccttcccaggagggaaaaccatttatcttccctcccactgtgttgtgagcattatcttcgtgtgggaggaaatggtaatgttgaatttaatgagaatgagagtcttgcttctctatctagatctggggcaagaatggggttgttatcatctacaaacatttcttggctgtgtgcacagcgcaggaggggccacgaggctgagcaaacactgcactcttagcgcttgcagaacccctgctcccctccatccagggagacagggttgcaggcctagccatgccatagaggcaacactcaggacaaaatgagtggcaagaatggtgaggagtggaagttctcagaggaaggagggatcaggccaggccaggctgctgtttgagtacctgggcggtgggtgagggatgaggggtatggaaggaatgtgagtggtcccttcatggaggtggcagctgggaggaagacgtcagaccagacttgctgcctgccctttcctcatctgtcccacccctgcctaccaaggtctctgaatttgctgggcgcagagtaaaggcctggagcatggggaagaggccacacgtgtaccgagtgagtctcagccttctgccaggccccacgctatgtgactttatgtaataatagctaacattttttcactgctcttactgtgtgctaagcactatttgttctaagcgctttccatgtattaattcattcaatctccacatgaatcctctcgtgtagatattgttattaactccattttacagatgaggaaactgaggcccagaaaggttggatagcatacccaggatcactcaatgaataagtggcagaactgtgaaggagctggaggagcccagggagttgggcttcagggtccgcagtgttctaacccaccctggagcactacttcttacctcatttgcacagagcccctgtcagatgggtgtgttcgtttgtttgtttgttttatgagtttcactcttgttgcccagactgaagtgcaatggcacactcttgactcactgcaacctccacctcctgggctcaagcaattctcatgcctcagcttcccgagtagctgggattacaaacacgtgccaccacccccgactaatttttgtatttttagtagagacggggtttcaccatgttggtcaggctggtctcgaactcctgacctcaggtgatccgcccacctctgcctcccaaagtgctgggattacaggcatgagccactgcgcccagcctattatcttcattttttcagacaaggaaacaaggatcagagaggtacagtgacctgcccgaggttattcaggcagatggagcccagaactgtctggcttccaaacctatggtacaccgctgcctcccgcaggtgggctttaaagacatcagagctactccaggtatgtggctctagcttcctccaacagagctcccaggaccactgctctaggcaggctccctctcaccatcaccccctgaattttggccatggtctcctagtagattgcccctcctgctctcgctccatcaagcctctgatgaggtgcagccagaccatgttctgcagtccagctccagtagtttcactctctctttggcctgagaactcctccgcctgccctgcatggtcttcttaggatctgtccccagtttgcctttttcctctcgtctttgtacagactatgctccagccaggctgacccgtgtgcccccctggttagcccactcaggccttctgctagcctctaggtctttgctcatgttgttcccttctcttgggctgctgtacccagttcccaggctggactcagctgttacctctcctatgtctgtttgctggtgtctctgatgtttggtctatccttgaccctctcaatgagcacattgcccctttttattccttcatggttgtttacatctcatgtcccctctgttagactgagacccccttcagatttacatttaactgacatatactgagtgcattttgtgtgtcaggttctgtgttaggtgctgtgggcatgagtgaaggagctaaaagcttggaaacacatagcacagcacatagtagctgcttaataaatactgagtagataaatgaatgtctgattgagtcctgctgaactaatagccaaaggtacctaattttttcttccttccaggactcctgtagtaagaaatgacaacttcagaattctcttggggtaggcacagtagctcccagcactttgggaggtcaaggcgggaggatcacttgtgccagggaggttgaggttacagtgaactatgattgtgccactgcactccagcctgggcaacaaattgagatcccatccctaaggaaaaataaattcttttggcttttctgtggcttttttctcatgctccctggagccattttggcctttgctgtctcttctcacgctcaccagccttccgattcatagaatgtcaaggtagcagacttggacgagactttggagacatttagaccaatctgctgatcattatctctccctgccatgtcaggctgtggtcctgaccctcgatgccaagtcttctgttctgaaaggagcaaagaggcctgcacaggacctgtgtgcagttcactcagcccagtgggaagttgcttatttatccatcaaacctttcttgagctcagaccctgagctggacatggtatctcagggttgacataagacttggcccctctgcctcactcactgcagtgttccctggcaggatcataaacattggtcatggggaagaatgcttagtaagtgacttacttcctcttttggggaagctcgtttagggcaacataatttgccagttactataacttcctcatggtatttggtttctctccaagcctgcctgttggaagcatttacacggggaagcccattccccagtgcttagtagctgaagctctctgggaccttagcattcagagaaagtgtggtgccatggaaggactttgtgtaactctaggcaaatcacttcactttcagagcctcagttttctcaagtagtaaataggaataaaactgtattttctgatgcatgagattcatgttgccagccccctacctccctcaaaaaaattgtatcagaaaatttcctggctgcctggcataccgtacatcaaggtcctgatcaggctggaaagctgagaatggaaaataatacatgagactgccctgccccctagaggcggaatgtggcaaacacacaacaatgcaaagaccgatgcatcgcatccctttcaaaacaaagatgacaagccagagctacacggctgatcaggattattcctccaacattttagatgtaaatgtatcactatcatcacctaataggtaccatttcactaatgtttcactagtgcatttcgttggagcgatgtgatttttatacctttttaaaggagtgataggactgcatatccaggccctgtgatttcctgctggattccaggatacagcatactgcattcacctgaataaaaccaatattttccttcatataaccactttagaattattgtcattatatctgtgatgaaaagtacctaacttggctcttcccccacattttcttataaatctgagaggcatctctcacaactgtatatctgatatgccagccaattcataaacaacccatctcattgtgatggttgtgaaaattaaataagatgacgtaggtgaagcgctgagcacacagtatgtgtttactcagcgatagccattattattaataataactctgtaaagctctgtgctgtgggaggacaggaggagaaaccatgtggcagctcaccacatttcagagagagaggtcagtccagtgaacattgcatgccaggatgtgccatgccttgtgccatcacaggcagagaattctatgattagtatatagttcctggcttcaaggtgctcataattgggtggagaaggtggtggtggaaatagacgattgcagtgtgctatccagtgtgtcatgccagaggggagcacagggggccacaggtgctcaaaggagagacatcaccctggactgtcagggaaggcttactggaggaggtgatacctgagctgaggcttggaggatgagtttgagttagctaggtgaagaaggacagcatgtgggttggtgggaattgggggcaaaagggaggttaaggcagaggggccagcatgagcaaacacacagaggtatgggcccagcaggatatgtgtatggggaggttttttgtttgtttgttttgtttttttatgagttcagtacaaactagagcacaaacagagagactcgcaggggagtctggagggttggccggctcacatcttgaggacacttcactagcagcgtcaggagctttctgctgttttgtttttgtgttgtttttgtttttatttttttgagacggagttttgctctttcgcccaggctggagtgaagtggcgtgatctcagctcactgcagcctcttccccgccccaggttcaagcaattctcctgcctcagcctcccgagtagctgggattacaggcgtgtgccactatgcctggctaatttttgtatttttagtagagacagggttttgccatattggccaggctggtctcaaactcctgacctcaggtgagccacctgccctggcctcccaaagtactaggattacaggcatgagccaccatgcctggccaagtagcattttaaactgggggagaggtgcttattgtggtgtgggagaacatgtcaagagccacgttttggagagatccccctagagggcagtttggaagatagattggagggtatccagggaggaggctggtacagcagtctagatgagagatgatcaggcctgtgcttgggcagtgggagtagagataacctatgtggggagaaagatgatgatggaggggagcgcagcctgctctggaagctcagaggagtggcagcgttcatgaccagtagggttttaataataccagcatagaaatcaagaaatcacaagttggaaggactctgacaaatcatccaactgaagctattcattttacagatgaaaagactgaggcccagagagagaaaggacttgtataaggccagtcagggtgtgagcagaaaagagaacgctgattagaagagtcaccctagtatgaatgccagcattcagagcatcttttcttttcttttctttttttttttttttttttttttttttttttgagatggagtctctcgttctgtcacccaggctggagtgcaatggcgcgatctcggctcactgcaacctccgcctcctgggttcaagggattctcctgcctcagcctcccgagtagctgggattacaggcatgcaccaccacacccagctaattttgtatttttagtagagacagggtttctccatgttggtcaggctagtctcgaactcccgacctcaggtgatccgcccacctcggcctcccaaaatgttgggattacaggtgtgagccactgcgcccagtgcatcttttcttaaatgtgctgttctctttctccccctagctcaggcccagccttctttctgctgttttttgtcttacgtggcttcatttactgtaactgaggcagctcagaggcagtttctggcctgacagccaggtctctcatccctgtttttctgttttcatggaagagggtggacctgtgtctgtctttagtatatccccattaccttgggctgggcagctctaccccgggtgtctttgttttgaggctcgatgatatgatacataaagaacgagctttggagacagacagacctggatttgaatctatgttccaccccaacccgcaggatggcctcagctaggtcattttaccttttatgaattttagtttttctgtaaaatgggataacaatgcctattatgcctatttctcaagtttttttttttgtttgtttgcttgcttgcttgttttgagacagggtctctttctatcagccaggctggagaacagtggtgcgatcacagctcactgcagcctcgacatcctgggttcaagtgatcctcctacctcagcctcccaagttgcttggaccacagacatgcactaccatgaccggctaattttttttgtagagacagagtctccctctgttgcctgggctggtcttgaactcttaggctcaagcaatcctcccacttcggccccctaaagtgcagggattataagcgtgagccaccatgcctggcatatttctcaaggttagccaaggtaatttcgatggcattccctgatactgtaggtgctccgtaaatagataatttcgatggcattccctgatactgtaggtgctccgtaaatagtcatttttcttctctttcatgaaatctcccatggacaatgacttaacgaatcaaagctttgcttcccctgaaaactggtatatttcttccttcctaatgtgaggctgtcatagctcattgtatcttcctttttgcctcagccaccagttaatttgaagcatagctctagcatctttgttgatttcttttttggacttattttcgagttcaatttctattctgtgttcttggagtaagcaccctcaaatcctttgtgactcaagcaggtataaataactaatgggtgtaaatagttgaatgaaagtaaggctgaagaggctggactggcgatggtgggatttgaagaggaccagaggtggagcaggctggggcagccaagacagtatctgtgtggatggctgtgaggaaccaaggggttagttaggaggggccaacccgtcacccgcctctcttacctcctgttctcaaaagaagcatagatattggagaacaggacctcatgtcacccagaatcatcagcctgcccatttcatatttacagtgtggaagccagagttctaaagaaagagaagggcttgttttgacaaactaaatcaaagcaatgcacatgcacaattttcaaaaggcaaagtagtacataaggactcatgtagtaaaaaactgacgtcttcctatcccctgcttctcagccccagatgcaaccacttttcccatttagttcttctggcggtaacttcatatctctaaataacgtgcttgaatgggtatttcctatttatcaactttaaacattatcttgactttttcctaccatgacaaaataatttagcttatttacaacagctgactctttctcaacactccttcccacttttttttttttttttttttgagacagggtcttgctcagtggtccaggctggagtacaatggtgtgatcacagctcactatgacctcaaactcctgaactcaggcaatcttcctgcctcagtctcctgagtagttaggaccacaggtgcatgccactacacctggcaaagttttatttattttttttttttagagacggggtctcgctatgttgcccagttaggtctcgagctcctaggctcaagtgatcctcatccttcggtcttccagagtgctgggattgcaggggtgagccactgcgcccggcccctcccagattttgagagttttattattgtgtgggctcctctattagttacctttgtaactttattaagtactattttaaactgacttcttatttcatcagttttccacagcatctcttgaccacgtactttgtaagacatagttattagtgccatccttccctccatctctccttcccctcttccacctcccagtctctatgttctgtacttgtgtatctagcaatgtagattacatttgcattctattctgtaaaaataattatgttttcaatgctttatctagagagattgattataaaaattacctggcagtacactgtttatgtgattatgactatgtcactattagtcatcgcagggccaaatagtgtactgtaattatacctcattactcacagttacacaacctttgtactcccaggattgttttaaaacttcataccgaaatataatatgaatacagaaaagtgctcatatcagaagtgatatgaccatatcacaagtgatatagtcactttttacaaaccaaacacctaggtaaccagcattcagaacaaggtctgttttttattcaccctgaatagtactcaagcagccctttcagtttgaaggactaagtctcttctttttttttttttttttttttttgagatggagtctcgctctgtcgcctaggctggagtgcggtggcgtgatcttggctcactgcaacctctgcctcccgggttcaagcgattctcccatctcagcctctctagtagctgggactacaggtgcccaccactatgcccggctaatgtttgtattttcagtagagatggagttttgaactcctgacctcaggtgatccactcacctcagcctcccaaagtgctgggattataggcatgagccgccgtgcccggcctttttttttttttttttttagacagggcctcactctgttgcatagggtggagtgcagtggctcaacctccacctgctggattcaagtgattctcctgcctcagcctcccgaatagctgggattacaggtgtgcactgccacgcctggctaatttgtatttttagtagagatggggtttcaccatgttggccaggttagtctcgaacccctgacctcaagtgacctgcccaccttggcctcccaaagtgctgggattacaggcgtgagccaccatacctggccctctccttatgttatttctttgatcattcccttcccttaatttgctctgttttcttgtttgggaatgtctcttagttgggtgttgaacttcctgtaggctgttgatcctgtaggctgcttaccttttctctcatactttctattttatggtatgtgaataagttaatagaaagtctgactgagccaggcgtggtggctcatgcctgtaatcccagcactttgggaggctgaggcgggaggatcgcttgagcccagaagttcgagaccagcctgggcaatatgataacatgatgaaaccctgtctctacaaaaaaaaaaaaaaaaaagaaagaaagaaagaaaaagaaaaagaaaaaaaaagaaagtctgactgagtggtgagctgcctatgtatccaggcttgcttgtccactcactggcttcattttggcgagctggcagggagttggttgttataatccccaaaggccagaatgaatagcactttattttgggggcaccaacatgccactaggtgtcttgactcatcctagatagtttaattcctttagcaagcagccctctgatactttgcctacgggtgaatgccaggcggcctgtgttctaggtctgggggttggggtggcagggaaggaaggatgtcatatacttaccttccatttatccctgtgtccagtgccgtggttcctcctaccctctcttgcagctaccatctccaagtctggagtctctctgggcctctgctggcctgactgtctccctcctcagctgcaagcccctaagtggtgttcctggatcttcctcaactgtgaacaccctgctgtttgtttttttgcttccagaaatttgttgaaatctctcacccactgatctcaccctctcccatcctcctccctgttatgagttcatactttattttattccttcactttcattatggtggggtcctgggagagagaggagataaacatttatgcccttgaggtggaaactaaggcgaaagctactttaaaaaatggttgttttgctttttcaacccagactgaaactggaaactattagtaggccccccacatagccaagcctggatgacctcatttggggtcatccaagctgtgttgcttctggccccagcccttatcataagcattcctccattggcctccagagcacccctttcctcaacctctgctgcctagaccatggagtcaagcgagccctcagccgaggaaccggacacctgggttctgatcccagccctgcccctgcctccctctggacccctgggccagcccctccacctctctgggtgccctctctgtggcttgagaggctctccgtctgctgtaagctgggctttgccgggattggctgggtgcttggagggcagcccagcctctttgtccaggcggtgggagcaagtgggccagagatgggccccaagcactcgggggggcttggaggctgagctgaggcttctgcaacagcaggctgtgctagctgctcccccttccgcccactctttcccatcatggctgaacctctatctctctgcctccagcagagagaggagagaaggcagggctagagagctagttctgttttcctttgcttcttctctctctctgtcattgtagtacccagctgatctgtgctacaatacctgtgcctaaccgcaccttccttttttggtgttccccctttccgtccttgaatgattgtctcttctagaagcgctccttgagtgttcatggggtggggggctttgggctgcactgtgtggtggggagacaggagacagatgagggagaggggccaagcttgcaggctggaatgggagatgaagtgccacttggctctgggatgacagaaggaagcagcagctgtagcagttaaaagcattggttttggaatcagacaaacctagacttgaatctcggctctactacttattagctgtgtgagtctgggtaagtcacattgctcctccgtacctcagtgactgcatccatacaatgagaagaactactttgcacaacagttatgaagactgtgcaaagtagtaggtacaactgtggaccactgtaggtgcaactaaatagtaactttatggctgggcatggtggctcatgtctgtactcccagcactttgggaggccaaggcaggattgcttgaggccaggagtttgagaccagcctgggcaacatagcaagaccccatctctacaaaaaatgaaaaaattagctgggcgtggtggtgtatgcctgtagtcttagctactcgggagactgagagcagaagattacttgagcccagaagttcaaggatgtagtgagctatgatcatgccacggcactccagcctgggtgacagaatgagaccctgtctaaaaaaataaataaggccgggcgtggtgggtcacacttgtaatcctagcactttgggaggctgaggcaggtggatcacttgaggccaggagttcgagaccagcctggccaatatggtgatactccatctctactaaaaatacaaaaattagctggatgtggtggtgcacacctgtaatcccagctactcgggaggctggggcacgagaatcacttgaacctgggagacagaagttgcagtgagccgagattgcaccactgtactccagcctgggtgacagagtgagactctgtctcaaaaaataaaaaataagaaaaataaatagtaactttatgattatttggattattataaggcagaatatgctaaggcccaaataaagtctgcttattactttattatgattatataacatatagtatttgcttatgattgaaaggagcatgaggttagggaaggtattctctaaggaggcagcttttgacctcatcactccttggatcaagcctcccaggggctccctggcaactacagaatgaggttcacgctgtgctgcctggtattcaaggctctcttggttgtaatctctgcctttcttctcttcaaaatgtaaatgtgaagtgatacttttctctttacttcctgaaaaagacatttgaaaagtgatagacaaatatttcatttgaggtatatagcagtcttcctcatcattgtcatcatcatcaacatcatttttatcatcccagaacctgtacagtgagttgtgttaaacaaggactataggaacaataatcaccagcaaaaggatagccagcaactgaaaccatcatggccttcattttgtcctttaccgccatctttgccttcaggattgtttggctccattactaaaagtgattccagtatccaacaagctttctgatttgtcctatggttctatttcttctttttaaataatcttcatgagactttcttgcataacaccattacctcatccacctgttcgctatactttttgtcatttctaggtctgattcttggcttccttagaaaagagtcttcctctctacctgaatcatcttccttttttttttttttgagacagagtctcactctgttgcccaggctggagtgcagtggtgcaatctcggctcactgcaacctccacctcccggattcaaacaattctctgccttagcctcccaagtagctgggattacaggcaccgcgcccaccaccacgcccagctaatttttttgtatttttagtagagacggggtttcaccatcttggccaggctggtcttgaactcctaaccttgtgatccacccgcctcagcctcccaaaatgctgggattgcaggcgtgagccactgcgcctggctacctgaatcatctttcaaaaggttttcactttcacttttttttttttttagatggagtttcgctctttcacccaggccggagtcaagtggcacgatctgggctcactgcaacctctgccccccaggttcaagcgattctcctgcctcagcctcctgaatagctgggattataggcgcccaccatcatgcctggctaatttttgtatttgtagtagagatggggttttaccatgttggccaggctggtctccaacccctgacctcaggcaattcacccgccttggcctcccaaagagctgggattacagatgtgaaccaccacgcccggcctacttttactttttacattgtcatgatttaggtgtcacttgaacttgggaatcatctttacctccccctagtgcttttctccttcctcgctgtcacaagtaggtcttcacgccacttgtggtttagggaagtgcttgcatgctcctttgggtaaggctacagctccactcattcctcaagtcactctgtttccttcctaaccctacactcaagttgtactgaactatgtagagtttgctaagcatgtcaggcttctttatgcttccatgactttattctggctgttcctatggctaaatgccctttttttttttttttgacagagtctcactgtgtctcccaggctggagtgcaatggtgtgatcacggctcactgcagcctctacctcctgggctcaagtgatcctcccactccagcctcccaagtagctgggaccacaggcataggccaccacacctggctaattttttggttgtttgtagggacagggtctccctgtgttgtccaggcttgtctcaaactcttgggctgaggcagtcttcccatctcagcctcctgagtagctgggactataggcacacaccatcatgcccacctaatttttgtatttttgtagagacagagttttgctatgttgcccaggctggtctcgacctgggctcaagcaatcctctcactttaacctcccgagtagctgggactataggcacacactaaaatgcctggctaatttttatttcattgtagagacgggatctccctgtgatccccaggctggtctcaaactcctgggctcaagcagtcctcccgccttggcttcctaaagtgctgggattataggcatgagccgccgtgcctggccccaaatgcctttttacccttgtctacatggcagataaccagttaacttttttttttgacatagggttgtgctctgttgcccaggctagagtgcagtggcatgatcatagctcgctgaagcctcaaattcctgggctcaagtgatcctcctgcctcagcctccctagtagctgagggaggcctagaaacttatttctctctggtgccaccacgcctggctaactattcaaatttgaagaacatctaagtacctcacactgttcaaggcacttggaaacagtgagcaaaatagacaaaacctctgccctgtggagctgagattctagtgtatggatgtctgggatgggtgtggaaaagaaacaaataaacaagaagacacataatatgtcaagtagtggtaagtgctatggggaaaataaagctgcatgagcctggggattgcagaaggcccagtcagctccaccacagccagtgtttgcacaaccattattaagcagcattttctcatttaagcattttccaatgttatcacatattctttataaccataatcctcccaacaaccgtatcatattagtgctattattatctccattacattgatgaagaaactgaaacttagggtcataaatcgcatagctggaagaggcagagctgagacccaaatccaggcctgtctgacctaaagcctggactcataactactgtcattctacaaacctcaacacaattctctgaagtcagaattattatgcctattttatagttggggaaactaagttcagagaggagaatggattcatccatgggttgcacagcaaatgaatggatttgaacccagatctgtgaaggctagggccttctacaaaccctgaggcctaaggctctatagacttgcctgcctctacatttctagggcccaagcaagttaccagttgaagcccttggccctccacacttctcttccctcccatagttcatatggagccttgagatatgtggataccccagccaacacctccaagccctgtctatctccccttccccttaggccgctccttggtcctaacagatggacctgggtaataagaccatgcaattcctgaaagtaagcccaagaaatttaggcaggaaattctgaggtccttggtgcttgaagtgcagcctagaagggacagggccaaagatccttatgggtcctgatggcattacagaccttttgcctgatggagagtggcccctaaaatgtgggccccagtgtagggccttctgtttatcagtacaacccataagattgtgattcgtaataggctggcctccaagatcctcctcctttggcttcctgagctaggtcctgctttgcagggaagggagcagggggtgttctgtgggcctgggccttcagaggctgtggccggtgaagaatagagctttcccagcaagccctggtggacatgtgcactgattcttatgccccccgcctcacagtattttgttcccagtactctcaggctacttaaccaatttaatttcttagtagcgtttaaaaaattatactttcaatgcatttttaaattaggaaatttagaaaaactaggaaaagtagaggagaaaaacattacacataattacagcacccagaggcagccactctgagcatctggtgtatttgcccttgttctctgcatttttttcatgtagttgaaatgattttacacatacaatttttgttcttgatttttccatttgagcatttcccatgtcattgcatattcttcataaccatcatttttagtggcaactgatataccacgatggacttaaccatcctcttaatgtagggtgtagaagctgtgctcatttttttcactggtttaaatcatgctgcgataggcttccttgcacacacagcatcaaaggaacttacagcttttagggaattgaccttatatagggacaattgtattcagcttatttccctttctagatggtccctctagctgggtccaattcgtttatttagtcattcatttattcattaatttcgtcaccacatatttactccatacgcctggaagccagactctgagatctgggggtccaagcaggaatgagacagagcgcctgactaccaggagctcccagtcgctgggagagtcagccatggaaatagacaatttcagaacagtttgatcagggctgtgatggagtcaagaaaaggatactgtgggagaacagaggaggggctcctaacccagcctagggatgttaagatacgcttcctggaggaggtggtgcctaaatgggtcatggaggatgaataggagttggctggaataagaaagggagcttcctgttaaacacaatgagttggataaacttatttctctctgttgctttcccaaatctcattaaaatatgaaaaaaggagtaaaaaaggtagaaacacataaggtctgggatgctgaccagaagtaaactattctacttagagaatcccagcagtgctcaggattgagaggtactgaaggtacatcctcagaaggcaggatgaagtatggacctgagaatgggaatgttgaaagtcttttctgtccgggcacagtggttcatgactgtaattccccccccaactttgggaggctgaggtgggaggattgcttgagctcaggagtttgagaccagcctgggcaacatagtaaaaccctgtctcaaacaaacaaacaaacaaacaaaagattggctaggtgtggtggcatgtacctgtggttctagctactcaggaggctgaggtgggaggatcgcttgatgagcccaggaggtcaaggctgtgagcgatgctcacaccactgcctcctagtctgggcagcagagagagaccttgtcttaaaaaaaaaaagtcttgtctttttggtccttccccaaccccatccagacagtgagtcccccactcccagctgcatccctgcagatggaggttgcttctttggagaaactgaagttaagaggctttgacttgaagtcaccaagtacagtggaggatggggtgaaacaggcctgcaggcaaagggatctgcagcctaaaacagtggaaccccaacttccttccacttaaaacagtgggactccaacctccttcaactcccccacttctaggacaccaaagtcaggtacacagatgagatcaaaggattgttctctggggaaactgaaaggccccagaaaaaaaggcctccaaaagccgacatttggaagtcttctaacaaaagaacagcctttcagcccagtaatttgatagtgaagcccaccacctggcaagccccacctgcacacagagtttccaagcagcttggtagtgtcatgggaactaatctaggaacaccagccaagaacccttaagattaggtatattttattttaatgtaaactaaacctcagtacactgggccaggcatggtggcctatgcctgtaatcccagcattttgagggggctgaggtgggaggatcacttaagcccaggagtctgagaccagcctgggcaacatagcaagaccttgtctctaaactaaaaaaaaaaagagagagagagaaagaaagaaaagaaataaacctcagcatatgtttttaaaaaccccaagctcttggtagccagagataatcagatagtccaaggctatttgaggaaaaccatcaacttggaagactgattgaaaaagcaaacaaacaaacaaacataaaaaaggaacttggaaggtaatgaagggaggagaagaaacctgggaaattaaaaatagtgagagctaaaataaaaatttcagcagaaggattagaaaataaaaggtgaggaggtatcctaggaagcagaataacaagacaaagggacaacagaagagaaaagatgagaaaattggaggatcaattgaggaactccaacagccaacaataggagttccagaaatagagaatggagggaacagcaggaaggaaattctcaaagacataatacaagaacatttcctagaactgaaggagtgaaaactcctgctgagtacccagcaagataaatgataaaaagacccatgccaagatatgccgctgtgacatttcagaataccagggattaaagggaagatcctaaaagcttccagagaaaaaacatcatatgcaaagaatcaagaaaaggaattacgttggacttatcaacagcaacactggaagctaggatatgatggagcagtgttctcaatattctgagggaaaagaatttccaacctagaagtctatactcagttgaatggtcactcaggtatgagggtatataagatctaaaggttttaagtcctatgcctcctttctcaggaagccctggggaatgtgctccagcaaaatatgagcataaactctaaaaaaaaaaagaaaggaaaaaaaaagccacggaatctaggaaacaggaagttcaacgcaaaggagaggtgaaaggaattcctagatgatggaaaagagagaggttcttttttcttttttttgagacggagtctcgctgtgtcgcccggtctggagtgcagtggcgcgatcttagctcactgcaacctccgcctcccaggttcaagctattcttcagcttcagcctcccgagtagctgggattacaggtgttcgccactgcgtccggctaatttttgtatttttagtacagacagggtttcaccatgttggccaggctgatctcaaatccctgacctcagttgatctgcccacctcggcctcccaaaatgttgggattacaggcatgagccaccacgcctggcctgagagagaggttgttagggcaacatctgggcaggcctagagagcagccagcctagattgcagcaggaaggtgggtgtttttaagggaaacaaagagtccgatggattacctgatatgtcaaagcatattgagaggagaattgcgcttctgacagtttggggagaattgatcatttgtatgaagagaactaagccgacaaaaaaataatggacagtaatcaggctgggcacggtggctcatgcctgtaatcccagcactttgggaggctgaggtaggtgaatctcttgagcccaggagtttgagaccagtctgggcaacatggcgaaaccccatctctacaaaaaatacaaaaattcaccaggtgtggtggtgcatgcctgtagtcccatctactcaggaggctgaggtgggaggatcacttgagcccaggaagttgaggctgcagtgagctgtgattgtgttactgcagcctgggtaataggatgaggacctgtctcaaaaaagaaaaaatatagacagtaaacaatagcagggaaaataaaaagttgtatgggaaaggaaatgtaatcatagtatgtcatatgatttatccattattagtatccatgcagtcataataacgtagaccaccagcctaggcaacatgatgaaaccccatctctacaaaaaatgtaaaaattagccaggcatgatggtacatgcctgtaataccagctactcaggaggctgaggtgggagatactgcttgaccccaggaggcagaggttgcagtgagctgagattgtgccaccgcactccatcctgggtgacagagcgagaccttatctcaaaaaaaaaaaaatgtagaccaccaatgttgatttaacccaaactttgtgatataactctgatggtagaatgagaggagggcacagttgttcagttgcaggacacttggagtgaatggaagtggtcactgcacagtcgtgtgtaaaaacagcatttaggctgggtacggtggctcacagcagtaatcccagcactttgggaggctgaagtgggcagatcacttgaggtcaggagttcgagaccagcctggccaacatggtgaagccctgtctttacaaaacaatatgaaaattagctgggcatggtggcacatgcctgtaatcccaactactcaggaggctgaggcaagagaatcgcttgaacccgggaggcagaggtcgcagtgagccaagatcatgccattgcactccagcctgggcgacagagtgaggctccgtctcaaacaaacaaaaaaaaagttcctttagcagacagtgtgagaaaggagctgacatttgcggttaggtgtaaggtgatattcaggagagaaaatgaaaggctgattcggggccggttctcagcttttggagagacccgcatgatttctgggccagggtacctgtctctttttccttaggacgctcctgggaggagccccgttcatagttgcccttcaagtttcattcttcaaaaaatctacttctgggccaggcgcggtggctcacgcctgtaatcccagcactttgggaggctgaggcaggtggattgcctgaggtcgggagttcgagaccagcctgaccaacatggtgaaaccccatctctactaaaaatacagaattagccgggcatgatggcaggtgcctgtaatcccagctactcaggaggctgaggcaggagaatcgcttgaacccaggaggcggaggttgcagtgagccaagatcgcgccactgcactccagcctggtgacagagtgagactctgtctcaaaaaaaaaaaaaaatctacttctgttgatgttcagtctcctttctgtaggagacataatcttttaggcatgttattcagattctggcttgaggaccagtctgtgatcattcaagttactccgcattatctcatttctgatgcattttgtatttatttaattagttttgctttcagggacaagcttcttgatctaatttcaggttcctgggaagaggcaccatattgttccccagttactgcttatgggtggcttggagcatggcaggaaatctagtcaagaggcaagggcagaaactccaacacagcagctccaaggcctccattcttttcagtcattctgctctgtcttccccataagtccccaaaaggttcaggaactttcgatattctgccatttattctctcatcttccagattgcttcttcttttttttttttttttttttttttgagacggagtctcactctgttgcccaggctggagtgcagtggtgcaatctcggctcactgcaagctctgcgttctgggttcatgccattctcctgcctcagcctcccgagtagctgggaccacaggcacccaccaccatgcccggctaattttttgtatttttagtagagatggggtttcaccgagttagccatgatggtttcgatctcctgaccttgtgatctgcccgcctcggcctcccaaagtgctgggattacaggcgtgagccatggcgcccggccaaattcttgtacgtggaagaagcaacattaaaatctctggtcagattacatgcctgtttttgattcagaaaatatggttactatcctcaaagctccaacaagttactatttattggccatcactgctgaggatgggagttggcatatccaaatctcttgagaatcctggggcctaagtggcctttcattaagacaaggctggccaggtgcagtggctcatgcctgtaatcccagcaatttgggaggctgaggcaggtggatcacttgaagtcaggagttcgagaccagcctggccaacatggcgaaaccctgtctctattaaaaacacaaaaattagccaggcacagtggtgggcacctgtaatcccagctactcaggaggctgaggcaggagaatcgcttgaacctgggaggcggaggttgcagtgaaccaagatagtgccattgcactccagcctgggcgacagagcaagactctgtctctaaataaacaaacaaacaaataaataaataaataaataaaaggctgtggggagtagcaggagaaatcggtctcctttactgacatggattgatgaagagggatctagtccttgggtctattgcttctccttgtagacagcagaatctagttgataaaagagataaactttggggttctgaagaaatagaatattttaaggcctaaagattgcttggaactcaactaacacagccctatcactttacaggtgaagaaccaaggtccagagggaaatgacttgtccgagttcacactgccaattagggaatgagccataaaaggacctagcattctttctaccagtctatactgcctcccaaaagaatggtggcccagcttcatgaacattggacagtgcatgagcctctgaggaggtgtaggatagcactgatgattgttctatacataatgaataatatgctaaatgcataaagggtgatggaccctggggtgagctgcacccccacattgagagtcatatgatgctgtgtaccctcaagctagtaagaatcagtccatagcgagaattggcgaattccccgctgcatcatgacttggagctcttttgctcccctttgctgccatcttgaggactgtcacatatcacatagaaatacttttggagcagagatatatttctcataatctctcaggtgaaagagcactggagaggaaaggtctgttggtgcctctctggcttgatattgaggaatgaagataagggaactcaccgtcatagtgcgtacgtgcccggcactgagcttctggtacagtggagcgtggtggtaggaacatgagctttggggttcactctgagcttctctgcttgtgtgaccttgggcaagtcattttgacctttgtgagtctcagtttcatcatcttgaaattggatgaataacccccactttgcaggatcaaaggagataatgtacaaaaagaggctaacactatgcctggtacatagtaggtactcatagtttgttcacagtggtggtgggggtgattagatgtgttgcttaaaccttaggtagattgggacaagtggccagtccacgagctccttgagaggttgtattcccagggcagggcctggtagacagcagactgaatacatgtgtgctgggtttgggggtaggtgggtggtgaagagatcggtctgcctagagcagagggttagtgttagggagagaggctgagaggcttggcctcagttctgtaggcatctggggagtcattgaagtcaggcccctcaggcctggtacctgagaataattgggccaggcctcagaagcaatcttgttgctgcagaaggagatggaacattttaataaatgtgataaggtgcgctgtggccctggtcctctgttccttcagggggctgagaaggctaaggattggtgctactggcatctgctgagcatgtaccatgtgccaggcactgtgctaggctgagcctcacagccacaccccataaagggagtgactctcaccgcagcccacccccaaagccccattttacaaggcaaagccctgacactcaacatagtgaaataccttccctaggattccatggcttgtgaatagtggaaccgggagtgctgtggttgcagcaccctgatgcttgcctgccccacctcgccagcggggcctcctttcattctttcaacaaatgctcccttctgaggcccacctgctcctctccctgtgtgtatctctgtcatttagcgcttagcatagatggacactcccctcactaaagccacgtcttggctctctcagctgaggacagagcctgtgctgtgttcatctctgtctccttcgcagcatgagtgagggtgggaggcctgaggtgaagatggaggaagatgacaagggggatgtccgtgtcccacacgctcccactttcaaattccatggtcctcctctgccccttccctgcacgcagtgaacaccagccccactgtcctgatcctccctcccgtacacacacacacacgtgcgcgcgcacatacacacacgtgtacacacgtgtgtgcactcacgtatacactctcacactcttcttgggaaggcgtggtgggagaggaagggtgtggttcagatttcactcattgcccggttccctcagtgatgtccccaactccattctcttctttcgcccttcttttgcctctaaagaggcctcacaatgaaaacggcagaccagtgtagtagaaaggagcccagcggctgactcatatatctcctcagcctcgttctcttcatctggaaaataagcaggttggaccaggcagttggcaaagccccttccatggtgttaataatacctggcatttgcgtaccgggttccaaagggctgaattatcccaacagcccagtgaggatcggcctcgtgtcacaaacggggagactgaggctcagactcagagaggtgaagtgacttgcccaggtcatggggctggtaagtggcagagccaatatctgaacctaggtcttcctgtgtttcaagcttgggctttgcccctgcccacggctgctggctgcctcgacgaaagccacgctcctcactgtgatccactaggccccacatgtttggttcctggtgcctctttgacctcacttctgaccactcttcccccttgctcactgcaccccagcaccaccgtcttcctctccatccctccaactggcgaggcactctactgtctctcggccttgcacttgctattctcttctctccgcatgaaataacccttcccctcatttttgtgatgtgcattaggcctcaaggccccccaaagccactctacctagggcagagggagaagagagcgtatactgaccgttttggttttttttctctgtttccctttcagatctgatggtgagaattccagaacagtcaggtcagtacctcctttctttagtactagttgggagatggggcagggcctggggtgggggcctctggtttgtaactgcaggatccatgggcaaggggaggggccaactcaagggcgtcttccctgttggtattaggggtggctatggagtggggtgagagggcagttgggggatgtggcagctgtggggagggggttcaagactgttccttagtctttctgacactagttgacttgggagcttggctgaacaccataggggctcataggagctgcccagatatgaaagctgagaggtcagctctggacaaggaccttttccaccttctcctcccagggtaagagggcatgatcgatgctgagcttccctggtctagcgttcactttccaccctgaatctgtgccagccctgagtagtgggatttgaatggactctggatgtaacacattctagacattagaactatacattatggcgacaaggaaaatttttttgtgtgtgcttggtaaaaaaagtttacaagcttcagtacgttttattttattttattttattttatttttgttgttgttattgttgttactgacccattggtagacatagtaagttttaaagatgtgctcaatctgccagttggggaggcaggagtaaaacttgggtaaaggtaaagacaagggacctttgtgcatttcccaggccttaccccatcagaagcttcatgaaggcagaggtgtcaagtatagggattatataggaatgatgggggtgctcaggataggacccactcagccttaacatccaggctgggggctatgggataggccactgagctgagctgagcccaggcagcagaggcacagatgggtacagtctttcccagccacggctgccagtagcataattggcacctttgtgaagaatagaaaaagatgtccctttcaagggcaccccctctgagtggctccattgagcatagcacgggttggatatcagcccctgttcatatccttttggctgtgaccctttgtgaaaggcacagcttgcctgactgtatgcaggagccctggtcctgtcattcaggcagtggatatgggctggggacagaggatgccagcatacagacaaaagtgtctaatgagacacactctgttctagcaccccagacaggggatctggggtaaacacacggatacccagagccaagaatggggctgtgggataaacacatgctgaggccagctttaatgcaatcagtcccagtgtccaggaaaggggtttgtgacaagacataattagtcctagcatgcagccaaggagcatgtcatgggcacagcttgtcctagcacttaggaaggcacctgtctagcaaagggaatagatctcagtgtcccaccgtgggtttggagagaggccacccgagcacggggctcctgcaagcatccccggtgatgtgcctgctacttgttgaagaagaagattgaaaacatctctagttctcagctcttcccagcaaggaagttcctgggacctagagctcaggacatttaataacgagcataatcataagtcatgtgatgatatacatttgggcctttacaacttacagaagttgtcagggactttcttttgtctgatcctcccagtgacactgtaggtagaacctgagctggccttatcatcattgttttacagctgaggaaactgaggctcacagtggttatgggttttgcctgcagccaggcagctaatatgtggattcagctaatatatggatcctgagccaggattcaaacccaagtctgcctggcgccaacccagagtgctacccataccatcaccacgggagctctcgacagcctggcagataataatcatcatcctcatcctcatcctaatattagcaattatagcaatcaccatttgttcctcacatactaacaacttggaatatgatcttatttaatgctcacaacagccctaataggcatggattacaatccctgatttacagatgaggagaaggaggttctgagagagtcagtgccttgggctgtctgattccaaagccagcatttaatttattcagacacgcttcctgacatccatcctgggcccagagtcaaggaggctgtaggggcctagaggagtcagcatctgggaagcgagggtcaaactcaggctatgggaaggggctaaagcatggcgtgtatggggcaatatcttgacaacatggtgggaaggcaacttgaacttgcaaccagggctgggtagggacctacttgtaaatttttgaattcgctccagttagggtgaaggagagcttgctggagcaggcagcgtctgagcagggctgtcggggactgccgtgcagatttgcataaggagggtgtccccggaggtgggatcagcttgtggagggaagcgaggggggtgggtttagagacagggagccatccgtggggctaaaatagaagatctaggcaggaaaagagcagtaaggtcagaacgcgggtcaggactgggtcacagcgaccttctgtcatcagtggggagctggggaagttggaggagagaggcgaggctctgtggcctaggaagggcagaaacactggatccatgcacaggcctccatttggggggtgggttgctctctagttgtgtgactggacaatctgtttgtctcttggagccccagtttcctcatctaataaacttcatgtgtgtgtggagggggaagggctagggaggtggaagaaacaccgaggagaggcgctaggcctgggcttttatgggaactgaatagcaaggagagagcagagtcggtagattgcaagccacccttggcatgacccaggcctgagggcttctaaagtatggggtgccagaggaagtgtggcgtctaattagagctgaacagttggtgatgggggtggggggtaggcatgggcagagaaaggtgcctggacttcttgtgggtccctgagaagtgtcacagatctgacctaaagataccttaagccaaggtccagagagggattggccatcgctcgaggtcacaaagctagctagcagcagagcctgcttcctagctgtgcactctttgcagaatcacttaacttctctggttcttagtttctcatgggtaaaatggaaacaatagtcttgacttctctgggttgatgagagaacttaaagtaaagcaatgcttggtgtgaaatagtggtgcaacaaactgtagtgtcctctgctttcccctaacccaatccattgtcatatgctatatagtcaggctggaagaatgtgaacaagtgtagaacttgaaaacagagagggcaggacgggcctgatgaggccctcaccagaagatgagggggcccaggcctagaggcactgctgcagtgagggtcagcctgaacttgttggccctggggaccaggctggggttgctaggcacgcaaggatgaaagcaggaggaggtggcctgttgctagggaaggagggagggggtgggggagccgctgacacccgcggagacagggacgtccctatggcaacgggagccactgcagttggaggagaagtgggaggaggagcctcccactgtgggcctcagtgctccaatctgtcctacaggagtttggattagataatctcttgttttcacctcttggcaatctgggatggccaagacctcatgaaccgtctgtggctcccccatccacatgtccaagacactacccatccccagagccatccagctgcatcacctcccatgatgcctcccatttggctcagcccggttgcccaccctgccctgttcctaccacttcctttgcctggaaccttgccacttactgcttcacagtctggggttgctgcagacacagatgagccagctcgggccagcccaaatgggagcgtgatgatggtgtagacagccagtttgtgaggacagaagtctagaggagtcagagctggattttgacagtgggagagaggaggaggtaactttccaggaagctaaagaagggcaagaaggggtaagaggtttctcttctcctccccttcctctctgtgttctgccgccgcctggcccagccccaggaagtgggtgacccctaagctggctgagtgcctggttggcaccgaaataaacttgccttctctctcttcccctccccttgcctctgtcccctctgtcctggctttaattagcagccctggggatgagtcacttggcagctggggagggaggctgcacagagctcagtgaagcttcgactcctgccctgagccttacgggcagcacctctgtgtttatgcatgtgggtgtgcactgctgcatggcagcgtggctgtgaagagcaaagtgcaacactgcatgctggcgcgtggccctgcatgtcagggggtctgcagagaaccatatctggttgctgctgcgtttgttgctgtgtgccactgaatgtcagtgtgtgtgagcgtgtggctggagcgtgtggctgtggttgcaagtgtcagggaaccagggagcttctgggtgaacaaacacaaacgctggacaattgcattcacccctctctacctaagtgttctttatgcgattttgcttacacaaaccctgcacttacattcccaattttcacttgtcttagtctgggtacactttgttgtgaggaacggaagcccactcaagctagctcaagaataaagggctaatgaggggactattgtgaggctacatttcacagaatctaagaacagttaatgaaaaacagccaggcctcacaccaactggaagtgggaccaggaagtcgaggaccaaggttgctgtctcgctgtctgcatctcctgggcccatgtctcatctttctccatctctcatggcttgcctggtccctgtcatctctttttctttctttctttctttttctttttcttttttttttttttttttgagccggatacttgctctgtcgcccaggctggagtgcaatgccatgatcttggctcactgcaacctccacctcctgggttcaagcgattctcctgcctcagcctcccaagtagctgggactacaggcgtgtgccaccacacccagctaatttttgtatttttagtagagatggggtttcaccattttggccaggatggtctcgatctcttgacctcgtgatcccccctcctcggcctcccaaagtgctgggattataggtgtgagccaccgcgcccagcctatcatctctttttcatggacttctctctctggaccagcttcctctgcttgcccatggcctgacatggccaccaacctggaagctatgtgaccttttccagcttcaggatctgcccctcctgccattggactgcagtgatcctccagcctgtggtaacacaaggcagcaaggggccgtgtgagataattgattccctcagaattggatgagaggagagagagaaaacacttggtacttcttgtttcttctgcagtaagcacagtttttatgtgtacccaagtgaggtcagagctggtcggctcagaggcaaacacttgtaagattgtttttggttcctattttatagcaagatgacctttgctcactgtgctttcaagttccatatccttgcatcaaaacatgctgttttgtctaaaagtgccctcttattttatgccgaaaaagcttttaaatgtacagtgaatattaccattgctaccagcttgtggtaatttttcataacctcagaacaactggtataaagctactgatggtacagctgctacccagctcttggtggcctcaggaattttgatattttatgagttcagtgactgaatttatagttacctccagtatataattacaagtacacattatcaatgttatcagcttgatgctggagcttacttttccactaatacaaaccctgcaggttttacattaattacagagggaactaatgaccccttagacaagttttcacctatgaataaagagttaggaatcagctgtgccagtaatgactgttctccagacacaggagcgatgtccacagctctggccttggccctgacctcgcatcctctggccgagactaggggcttcccatcacctcctcagaggcctcctgactctggcctggcacacagcaggtgctgttatttttaataaaattgatagttttatgattgctattaaagccatcttccatatctaaatggtaaacctaagtgagagagattatcccaggttctgggcagtctccttcaactcctccccctgcccttttctcactgttccaaatagtaataattgctttgagtcagaaaatgtctgctaaatatcaggtactattacagagcactggagacacattatctttaatctttgtggccaccctgccaagtaggggtgacttacaggtggggaaactgaaacctagagaggtaaaatgacttgccccaaattgtccatccacacatccattcatttattccttcattcaaggatttattgagtgcctacaatgtgccagatgctgctaaatgtggctgatagggtggtgagtaacagccctgctgtgatgaagcccactgtctggtcaggaaatagacaaggagacagacaattacagacaattataggggaagtgcagggtgctgtgggagcaccacggaaatatacccaacccagcctgagggccagggaggcttctccaagctgacatctaagtggaagcttggagcatgagtagaagttagccaggggaggggttgggtggggcaaagtgaagtgaagagtgttgcaggccagaactgcgagaagagtgtttggcacccacgtttgtgaagaactaaaggagtatctgcagtgagatggcactgtcatgagaaacggtctcatctggaaagggagcagaaggtttatcgggaggctggaactgtggccctggttgcttaagtccagagctgaggagctgcaggacccagtaacagtttccatgtgacaattgtgggcctgggagcctcctgggtcggcctggccaacagcaggctgggattctagtggccacagtgccctctagtgtccactggcccaccttgcagcctccacctctgtccattgtccccccaccatgtgtgaccaggtgcccggtgctgagtgctggggacactgggatgaacaagacacagctctcacagagctcccgacagagaaggggcagcaggcatctgaacacagtgttgagagaagccggctgagaaaagagcagggcggaaggacacaagggaggtgacccaacctgcttgggtggggtcaaggcaggttcccagagggcacaacatctagctgacttttgaagaacaagggggagccagccaggtggggagatgacagtgggggcacagcgggacaacagaggtactattacagagcatttgacacacattctctttaataaggcttggagcagcagagtgtagctgagagagttgcaggtgcttctgtctgggtggggtgcaggttgaaggtggggggaaggctgagactagctggaggtatggggtaggggctagctcacagaaggttctaggatgcctgccaccagctcatcatgggcacttagtgaatggaatcatataagaagcttccctaccctttgggatcacagacccatccgaggatctgatcaaagctagagatgttctccccagaaattaatgcttttcatacaactttaggggcttcaaagatactccccaccccacatgcctgtcccaaaccacaggcttccaaattgctcttcctatagatacggaaaccccgacagaggcctccaaggctctgcatgctgggcccccacctccatctccagtctcacctttctcccctgtgctcttcccaccccgccacgtcagtctcttcgtgcttgctggaaataccacctcaggtcctttgtccaggttgtttcctctgcctggaatgctctcctcctgccatctctactttttgctcagttgaattgcattagttggtgaatgtctgtctcttctcacttggatataagctccatgagagcaggacattgtctacctgtagtcactgctgtatccagcaccggggacagtgcctgggccacagtatctgtcgaataaatgcatgaaggccctgccagtgtcccgtggctgggtcaggctcctcacccttcattccttcctcccttcagcctctggtgggtcatcatctgagtctgttcagcatgctcagctgtaactgaattccaaaagtggtcccaggttcagggatattttcttagaaatcttcctcactatccctgaaacaaacaggcttcccatgggtctcctctgcctctctgggagaagggacagactctctcaggttcaggctgagactatttaccatgtgcacactttgtctacctaccaaatccctacaagaactgtgaggtaggaatttccactcctcttccatagatgagcaaactgagcttcagagggcttacccagctaaaaagtgatagggcaaggacttgtacccagctttaccaggcaccaaagtgtaggttctttgtctcaccagagagggaaagggccttacccaaagtcacacagcatcatcccttaaagctaccactacactttctttctttctttttcttttgtacagggtcttgctctgtcacccaggctggagtgcagcggcatgatctcagctcactgcaacctccgcctctggggcttaagcgatcctcccacctcagcctcccaagtagctgggactacaggtgtgcaccaccatgcctggctaatttttgtatttttagtaaagacagggttttgccatgttgcccaggctggtatcaaactcctgagctcaggtgatccaccgtcccccacccaccccactgctcccagcctcccaaagtgctgggattacaggcgtgagccactgcacccggcccagcactacacttaatgtctctcggctcctgccaggtcaagagggttcagctcttagggcaataactacaaatgggcacaaggtgaagctgctgcaggagctaggagagttcctcaaggagagttaaaaaaaaaaaaaaggcagatgctaaggccagagccttgaggaccagggctttgaggggtgggcagagggagagaaggtcactaaggacccacagatgccaaccttgtggtgttccggagggcctctctctctcagtagctttggctttcttgagaggaaccagctgccccagcagggaggcaggaaggctggcctgttgcctgtcagcttctatttcttctagatcactggccccctggcccctcccagggccgccttctgctcagaacagccaggggcctgggctctgggaccgtgaaaggacaggagcactttgagctggacctgtggtattctcaggagccctacatccttcaaagccaaaaaactctctcctttctccagtcccgcccatgtggaggacagagatgttgctgtaataggcaggcagggagccagggcacctggagtctactctgacctgctgcatgaactttagtaagacccttttcctctccaggcctcaatttgcccatccataaagtcaggctgggcagtttacttggaagaacagcctcttggcatttcttttgattttccctcttctcttcaggaagcatttctctcagccagtctagaaaacaacatagaagagtgagagcttattgcagtgagaaagaatattggccggggccccatcttgataccccaacatgggtgatttgaattgcacttaatatgcagagtcccagaacaactcctaaacatagtctctttaactgtgctgaaaataagggtatttgtgaaaagcttctatggaaaggtttctgtactcacaaggtagcaatatggctgaaggggcagattccaggtttgggaatagccaaaccgggtcttgatcttggggttctgccacttactagcagtattacttcacctctctccatctcaattttctgttcaggagaatagagccagcgatacaaacttgatggggtgcgtggggagattctagcagaggtgcactgagggagcccagcctggggtttggcccagaggagggactgtgagctctccaggccgcttcctcggaggaggagttcccagccctcctggaggagtaggggaaggagcaaagtttccagttgcaatctggcccgcagcccagctggcctggccccgccttcttggttcctccttctagggaagggctggggaggagggggtggtgacacggtggagacaccggctaggccagggggcctgcccttgggacaggtccagacccatggagccccccgggaggagcagcaggtaggaacctgggccccgcagcctggccccctcccttcctgcccaggcctggacccagtccctgggctactgattcagcagcctcctggcttcctggttcctggctcccttcttggactctgagaggcctttggcctgggggagggagccagttcaagtgggagatcccatgggcatccaggtgcccagctctggaaggaccctggaaccctgagcagcacagcctgtggcctgtgaggggtgagcttggctcctaccctgctctactagccttgtgtgcgaggcactgcagggctccaggctcgtggcctctgagattctaacaccaacattccagcagcctaagagtctctgagtctcagattcaaaagagataatgagtcaaggacttgggctggagactggcacctgagaagcagttgccctgatgatgattaatccagagccttcgataagaagagtctcagattcaaagattccctgtaaggttctgagatttggacatcctcaaattcgcagctggcctggcccgcagccatgtctcctggcttttacatgggcttttgaatggccaggccctgaccacagtctgcctctgtgggcttgtgggggacaggggctggctgacctggaaggggtcggctccactcccagcttgctctggctccagctgactggcatacctctggcatctgcgctgcactgggtagggcagggaccaggccctcagcctccctgccctgctgtacctcctcctccccttggccattctccggactttaatcgcaggaggcaggaggtggaggggtctttggaccctgcactaggggtggtgggggcacagcatcaggggtggagtgtgggccccgccttggggtggggggtaaagcactggccttcaaagcaaaagactcctacctggaaccaccccatcctctgcctcacccactcagccctgagtcccatcctgtcaccaagaccactgagaccttgtcagcctcctccgccctcaccctcctctgctctggcgctctctgcctctctctggcttctctctgtgtcttctgtctcgccctttctctgtcttcctctttctctgtctttctccttttctgtctctttcggtttctctctatctctctccctctcttccttcagtgttccccttacccacccacctgggttctcccccttctttgggcccagagcttctccttcctccatcccttcctcccttcctgtgagggatcttctctaaggggagcccccatgcatctttcccccttctctttcatccccccttcccctcccgtcctccctacccctgtggcgtctggtgtgaggagggctcccttcccccttccctactgtggtgtcccagcgtctctgtggctgaggtccccacggagtcacctggaacacaggaggcccagcccggctctttcgtctctactgccccctgttgtcgttgtgttctgtatgtggttcgagtgccgtcctctctttcttgactttgtggtttttttctttttttcttccttccttccttccttccttccttcctccctccctccctccctccctccttccttccttcctctctctccatcttcctccctctctcccttcctcttttcctttctcccttatcttccttcctttcctccctccctgcctcccacgcctcctcttccatttcccatcctccattcctcccagccttcccttttcccctcccgcactcactctcaccttcttgcccccatcgcccaccctgccacttccctccctccctgtctctctctctgtctctctctgtctcttgctgtctctcaggtccacagcgtctcatactctacaccagtattgctgtcctactcaggtccttgactccatgaagcttaccccctcaggcaggctggcagagagcaggtaagagctagacccatccctcccccaattcctcctccttccagacaaatatacagtgtcattgccagcccctcccacctccctgagcccctgctgtgcctgtggaatgggtgtccgagtgtatgaggagagtgcctggaagatcaggtcagcagaccaaagaggacatttgggatctatctaatttgtccttccttaaaaaaatccttccctagagacctgccccaaaaggcctgagtggttggtcctagactatgtgataatccagcttttttaaaggatgaataggagtttgccagttggatagactgaggaagggcagttaggcagagggaacaatctgcccatatctttgcagaatgttatttcttttttttttttctgagatggagtcttgctctgtcgcccagactagagtgctgtggtgcgatctcggctcactgcagcctctgcctcctgggttcaagcaattctcctgcttcagcctcccgagtagctgggataacaggcatgcgccactacacctggctgatttttgtatttttcttttagtagagacggggtttcaccatgttggccaggctggtctcgaactcctgacctcgtgatccgcccgccttggcctcccaaagtgttgggattacaggtgtgagccaccacacccggctggaaaacattatttctaagttaattagaaaacctattttatgttttctaattacagctcaataaaaggaaatattaacagcagcagcaaaaaggctaggccctcctccctatttgaaagtttaaaaatacttgtgttaaagaggaaataagagtggaatttatggactatttagaataaatgtcagtgagaatactacaacttaaaacctataaaatatgggcacagggattcccagaggaaaatttataatcttaattgcttttattaaagaacaagatggtttaaattaaatggactaattattccactcaagaagctagaaaaaaacaaccaaaacaaagcagaataattactacaaataaaaccagaaattaatgaaatggaaaacaaaagatttgataaagtattaataagtaagtaaatatgacttttggaaagaccagctctacctagtttggtagacattctttggcagatatgactaagaaaaaggctaaataaataaatacattaagaaataaggaaggggatttaaccatagattctaaggagatgaaaaaaaagttattataagaaaatattggggccaggcgcagtggctcacgcctgtaatcccagcactttgggaggctgaagcaggcagatcacgaggtcaggagatcgagaccatcctggctaacacagtgaaaccccgtctctactaaaaatacaaaaaattagtcaggcatggtggcgggtgcctgtagtcccagctactcgagaggctgaggcaggagaagggcttgaacccgggaggcggagcttgcagtgagccgagattgcaccactgcactccagcctgggcgacagagtgagactccgtctcaaaaaaaaaaaaaaaaaaaaaaaaagaaaaagaaaagaaaagaaaaaaagaaaatattggttggacacagtggctcatgcctgtaatcccaggactttgggaggccaaggtgggtggatcacctgaggtcaggagttcgagaccagcctggccaacatggcaaaaccccgtctctactaaaaatacagaaattagccgggcgtggtggtgtgtgcctgtaatcccagctactagggaggctgaagcaggagaatcacttgaacctgggaggcagaggttgcagtgagccaagatcgtaccactgcactccagcctgggtaacagagcaagactccgtctcaaaataaaataaaataaacattgtatatacttttttaccagtaaatgtgaaaatatagatgaattgggtggttttctaggaaaatgtaaattaccaaagtgacttaaggtgggacaggaaacctgaataaaatggaaaagtagggaagaaacttaaaagatggtcaaagtggccgggcgtggtagctcacacctgtaatcccaccactttgggaggccgaggcgggtggatcacgaggtcaggcattcaagaccaccctggccaacatagtgaaaccccgtctctactaaaaataaaaaataaaaaataattagccaggcgtggtggcaggcgcctgtaatcccacctactcgggaggctgaggcaggagaatcgcttgaacctgggaggcggaggttgcagtgagccgagattgcgcccctgcactccagccagggcaacggtgtgagactccatctcaaaaaaaaaaagaaaagacggtcaaagttttctccccagaaatggtaccaggtccagttggtattctggaagttctggtatgatggaaattctagcaaatcttgaaagatcagataataggaaaagatagatagcttcccagttcatcccataaggctagtataactagacaggtttaaacaaaataaaaaaaaaacaacaactatagcctaatgccacatattaatagagcaacaactattttcaataaaagattatcaaatggaatccatcagtgtattaaaagaagaatatattgtgacaaatgaaagtttgccccaagagtgcagggattgttcaacattaggaaatgttattgtaatttattgtattaagatattaaagagaaaatatcatataatcatctccataaatgctgaaaagtgatctgattaaattatacatctattctgctgtattggggtagtttgttacacagtaatagatgactaaatagtaagctaggaatcatgaaaacttccttaacttggtaaagaatttttatcagaaaccaaagagaatcatcaaatgtaacagtgaggccctagatacatttccattgaattcaggaacaaaataaggatggctgctatcactgttattaaccaatatttttctggaagttttaaccagtgggattaacaaaagaaatacatggtataaatgttagaaagacaaagttagaattagcattatttgaggatggtatgattgtctacttagataattgaagagaataaaatgaaaaattagtagaactaagaagaaaagtcagtgcagtgagtagacacagataaatatacacgcaaaccattaacttctctgagtaccagcaataactaattagaacacataatagaaaagatcccattcacaatagaaaaaataattctataaaaccactatgaatttacaagaaatgtgaaatacttctctatagaaaactataaaatttaatcaacggctgtaagaagacttgagtaaaacaaagttatatcttgttcttggatgagaagagtcactgtggtaaaaatgacattttgttcctaatttggccaaaacattcattgcattccttattaaaatttcagtgatattttctttgggatttgagtgattggagtttaaagttcattcagaagagtaaatgttcatgaatcactaagaaaattttgaaaaagaatgcaggtggctgggcgtggtggctcacgcctgtaatcccagcactttgggaggccgaggtgggctgatcacgaggtcaggagatcgagactatcctggctaacacggtgaaaccccatctctactaaaaatacaaaaaaaaaaaaaaattgccaggcgtggtggcgggtgcctgtagtcccagctactcaggaggctgaggcgggagaatggtgtgaacctgggaggcagagtttgcagtgagccaagatctcagtctcaaaaaaaaaaaaaaaaaaaagaatgagggcaacttgttgttctgttagatataaacttaccataaagctgcaataatttcaaatgttctatcacagaaatagaggactacagacatgaaacaaaatagagagtttagacacaaacttatgttcatatgggaatttaattcatgacaaaagacatctcaaatcagtggggagtcaataaatgagatgggactattggttacccatttgggaaaaaaaatttaagtgaaatccttgtctcatatgaaaacaaatacaggccaggtgcagtggctcatggggttacatgcctgtaaccccagcactttgggaggctgaggcgggtggattgcttgagctcaggagttcaagagcagactgggaaacatggcaaaacaccaaaaatacaaaaattagccgggcctggtggcacatgcctgtaatcccaactcggcaggatgagacaggagaattgcttaaacccgggaggtggaggatgcagtgagctgagatctcgccactgcactccagccctccagcctaggcaacagagggagactctgtcaaaagaagaaaaaaaaagccataaaagtaccagaaaaaaatctggaatattttaataatattaaggtggagaaagccttcctgagcatgacttaaaaacccataagctataacataaagagtaataattttggctacattaaaatttaaaacttctgtgtggagaaagatgctatacacaaaattaaaacataaacaggctaggagaaagtgtttactacacagatatcaggcaaaaggttaatatctctgcctatatctatatcaccttctggaaactagtaagaaaaagatacaaaacccattcaaaatggagagataacatgatatggcaattcagggaagaaatagacaattagctaataaaggagaaaatatgcccaagcttactaatagttaaagaaatgcagctaaagcaggccgggtgcggtggctcatgcctgtaatcccagcactttgggaggccgaggcaggcggatcatgagatcaggagatcgagaccatcctggctaacatggtgaaactccgtctctagtaaaaatacaaaaaattagccaggcgtggtggcgggcgcgtgtagtcccagctactcaggaggctgaggcaagagaatggcgtgaacccgggaggcggaacttgcagtgagccaagattgcgccactgcactccagcctgggcaacagagcaagactccgtctcaaaaaaaaaaaaaaaaaaaaaaaaaaagaaatgtaactaaagcaatgaagtgccatttttaggttcccaaattaaaaatattggaagggttctggagaaacagaacctctcagataccttctgcaaattggtaacattttttatggggctagtttgtcagttaccaccagaatcctaaatgtctgtattcttccatgctgagaaccatatcctggagctagatttctccaaggtcttgcttccagaaggacctcaacttggccaaccagaggccttttctaaaacaccacaatccaaactgcaaacataagccagactgtgcaactctttatcacctgcccttgtaggatatcattctcaaccaactcttaactaaaaggtgcatgatatatgcttctcaaaagaaagacaagattatgtgagtaggaataatctttctttacagccagactgcaaacatgttaaagtaacggaaataacttttatgtgcactttaaacaaaatgtgcattcctttgacccagcagttcaacttttaagaatcttaaccttcaagaatacttggagacatatgcagagatgttcagtgcagcattgcttgtgatactgaaaaattaaaacaacctaaatgtctatcagtagggaatagatcttagtccatgatatacccatattatggattactctgtagcagatccaaagaaaaggtagctctgtatatactcgcacagcaagatctacaagacttactgttacatggagaaagcaagttgcagaacagggtttacagtataatcccatttttgtaaggaaaagaaaacccccataacaacagtgaaaacatgttatgaacaccctgtcatcatttcaaaattactggcctttttccttggtcccatttccttgcttttattaattcatttccctcctcctttataccttgtccctgtatccagctgttcagattttgtttagatccttttaataattagctcagataccacatcattcattcagcaaggattctgtcttgcctgctttagattaggccttgtgctgacctttggtggaatattggaatgaattgtatctgatcctgctctcatggagctgaagtctagaagggagaaaggcacatagacaatgacaccgtagtgtgatttgggatgggacagaagtaggcccagaaggctgccagatgaggggcaattaaccccatctgggaaggcttcctactggaggggacgtttgtactgagtcttggaagagtgctagctttccttcatccccttcctccaccagaaatggtcttgttcactctttggcccttccaagcaggatgacgtcataggggaaaaatagtggagtcagtacctttattcaagtccgagttctgccacttaccaactcggtgactctgggcaagtcatttatcctctgagcctctgtttcctcatctatgtaatgcggctaatgccaacttacctcttagggctgtctttaggattggagataatgcatgtaaggctcctgggtgactgtcagctctagaagaggagggactacctgtgtcttgttttcctcatagccaactgtgtagcattgaattggattcgatctcaaagctgtgtgtattagacggttctggagcaaagaatgggcctgaccatagcagggctttgggatgagaaggctgagaggagtacagggtacatgggttgcatcataagaagagagaaccaggtgcctggtcttgccttatataaaggtgatgcaggagggaaaataagagtaggcgttcctgggaaagggattccaagtagggagttctggccctggttcttggtcctcttctactgataccatctcctaatctcacagttcagagcagtgaggcatggtggaccactacttgccatggcattcatggcaatttcagtcccaactttgtcactcactagctagctgaccttgaccaactcacttcacgtttctgagcctagttccttatctgttaaacaggactcaataccaccaacatcatggggttcatttactgaatgagctgagctcattcagatgaatgcattcagaatctgagtggctggcacataatgggtactcaggaaagagtagctattattagtgttgatttcagtagatacttttggagtactgctgtgaccagggtctctgttgagtaacagttcttgccctccatgagttcccagtcactcagggagactgagaagggccctgacagaggagaacactgaagggtatggaagcccagaggaaggaatttggccctgtctggggctggtacaggtcaactcagcctaagagctgggtcttaaaggttaagtaagagccagggacagaagggtgaagtgtggaagagcattccaggcagaaggaatagcatacagcatatggaaaagaaacgggatgttattgggaagggccagaagttcctaacctggggtgcatgggtctcagatgggcttcaggaaccccacgaacctccggaaattgaatgcaaaatgttgcattcatatacctatgtgcattttttggtggaagagatggtccatggctttcattaaattggtaaaggggtttgcattcccctcaaaaagcttgagaaccaatattgttggtgacaaagtgtcagttgaatggattctaaataggagagtaatttggcaaaatttgtgttttagaaacatcacattagcagtcagtatgaaaaatgggttgtatgcagggaaaccagctggaaggcctaaactggggtattggcagagaagaaatggatttgagcagggctacggtgttgcacgactccagtgagcaccatttgttgagaagcactttaatttcaaattatagaatccaaatcctttgagagttattaatgagatagactcaatagaagtgtcagatgatataaactgttgtggatgtataaggtgagggaaagggaagaggcgaggatgagtcaaagttagcagagggccagagggacatgagtccatgccagggtgatagtgcaaggggaaaagggaacctctattaatgctcacccagcatccagagtccttagtctcagacatatttactaactttcatcctacccctggttctcagagatcccaagtgacactggcaatactcatttccctgcggattttgcagaggaattacttttgctttgtgagttaggtcaagtttcctgaagaaagctgtgtttaagccagtcattcaaggtccatgaggattctgagagttagagatgggggaggaggtgctgacagtgtccgcaaaggcctggaggtgagcaaggtgaaatcagacattggagggtgcagaggtcaggcttacctcaagcagctgtctgaagagtataggctttttattttattttattttttttttggtaggcagttggagagccatgaacagttcttgaataggaaaagatgaaaagtgacatgatcaaattagcgttttagaagggaaatgagggaggaggctatgcagtaatccaagggagagagaagccaaggtcgtgggcatagagccgaggagatggatttgagaggtgatcaggaggaagagaggactggagtcagagactgaagaggtaaccggggagagaggaggaggtggagatgacagaggctggagttcgcagtaagttcaagtgttcatgcctggcactggattcattcattcactgaatatttattgaatgccaggcactgtgttaggcactaggggtttagcactgaacagaacagatgcctgtcctgatggatcttacagtgagtgagacagaaaaataaataaacaactaaatgtctagagtgtatctgatgtcgataagtgctatgaagaaaaagctggggtgataaggtagagaatgttggggtgccttttgagagggagggcctctctgatgaggcagtatttgagcagaggcttgaaggaggtaagagagtgagccgtgtacctctcagggacgatgttccagatagaaggaaccgcaggtgtaaaggccccgaggcaagagtgtgtttggtctgtttggggagcagcagggagaccagtgtgatggggaaaaggctgaagaaggagtgagaggagtagaagatgagatggtaggggcaacatcacagtctatcttttagagctatttaggaggtagagtccacaataattggtgactgacttgctaagagggcaggaagaatctagggtgactccaaggtatgttttgggctcaggtgactggatgaatggtggtgccttaaggacaatggtgagatgctgagtcagaggtccctatgagagctgaaggcccaaagggccatcctggtagagctgtccagcaagcattgggctcgacgggtccgggacccaggagagggatctacacctgaagttatgaaatggaatgagatcactgaaaaagtgtggagtgaaagagaagagggccagagcagaattgggaaggggaaaccaacgcgtagggaaggagcccaggaagaaatgggggcggggtcagagcagtaggaggaaaagcagtgggggtgggctcacagaagcagaggaaggaaagggccatgcagaggagggccttgttaagagtgtcaaatgttgcagcctgggctagtaagccgagggcggaagagagtctattggctttaaccatcaggagggcctgggcgaccttcctcagaacagcttccatggagtggtgggcgcatgaggcagattggagtgggtcgaagagctcgtgggaggtaccgaagtgaagcagagatggccagtgtagacgggtttcttaagaagaagcttagctgtgaagaggagagagggacagagggggatgtgggggcagatagagggtttttattcccagatgggagagacttgagcttctataaatgttgataggaaggaggcaacagagggggagaggttgaaaacgcaggagggagaggggatgattgttgtggaggaggtaatggggatgggctccagagtccaggtggagagactggccctaaatgctagaggggccccctctttcttacagaggagcaaagcagtgatagtggtggggatacaagggtattgggggattggtgaaagaaatgcttcaggaaagttcaaagcaacaaatggagagccctggccaagggaacggatgctggagctggaaggaagcagagaatacttctggctaggacttccttaggaagtggcacttgagctgggtcaggaaattcagaaaggatggtaataggcaaagatctgtgcagagggaagagtattctaagtggaagaaacagaatcagcacacacatagagatgtgaaaaggccaggcatgctgatggaataatgaacaagctagcttgatgaaggctgggcatcagtgagtagggaacatggataccactataatggccgttataataatagttaccatgcactaagcaccagccttgcttagtacatatttgaattcctttagtcccactgcaccctgcagaataggtatttcctcagtttgcaggtaaggaaagtgtgtcctggaatggtgaagaaatggacccaaggtcatccggctagtaaatgatggggctggtattgaaactcaggtccgtctgattccatagcctgtgcttttgccatctaacaggaaaggcctggtgaggccatatggtgggagagccttgaatgccaacttgaggaccctgaactttatccaggaggcagtgggtgtctgagcagaagagatgcatgcttgaaggtgggctttaggaaggctaatgtggttcaagaagggagggagaagaaatcaggaggtgactgcagtgttagggggagaggaagcaggggcctcgcctggaaaagaggggagtgagcagtgggaatggaatatcacttgttcctcatgacagcctggagaggtgtggatcttctgtttttatagatgaggaatgggacactcagaaagggagggctacttgcccagaacttgcgccctgcttcatgtgattttgctgattcaggaagtccgtggaacaatgtgtcagagggagctctgagtctgagaaaggcgtgtgcgtgcgtgtgtgtgcttgtctgtgcatcagatggacagcaatgccttcctttcctttcccttcacttccctgtctgcgttccttcccacctcttcccattcttccagtctcctggattccataattcctgcatcccctgagccaaggggtctgggaatgagggtaactgtttccttgtctgtccccagaaggtcagccttgtcactcccaagtcacctggtcccctcccagcccaactgtctgtccatccaccatatgaaactgtagcccagcaccagtgaatgccacatgcagcctggcccctggtactgctcagcagcaccctagggataggtgcttgttcctgcagcgactcttctcccactgctgtggctgcttctgtgtgggcagacggccactttgggaattagattcagctcacgagtagttaacaataatcaccaccatgttcccattgctggtgtttgccagacacttgatatatgttctagttcttgcaacagtcctgggaggttcacatcacgagccccatttttacagacgaggaaactgaggctccaagagtgacaataatgcgctcaagggcatatagcctggaaccacttgtagagctgggatttgaacccaggtctgtttgcttccaaagctgtgggctttccgtactccatttccaagtatctcccattttcctgagcctgaaccttcaggaaatacaaatccttgtccttcaagagcagggtgggtttctagagatagtgccaagttcacccaaaggacctagtgggatgagtctgagacttggagctccaaaaactctgggttcaaatcctgactctaccacttacccagctgtgtgacctagagcaagttatctaacctttctgagttttaattccctcatctctaaaatgctcctctgcagagctgttgtaggggctaagtgagatgatgcgtgcaaaatgagagcaggttgctgttattatattaaaatgagggtcaggcacctggcagggttagaaagggagttgatatacgctgagggtgaccttaagactgagcccaggctgggtgtgggggagggctgtcccagcacactgagttgggtgtgaccctggataatccatcacactggcctccccaccctgacccccattctcgtcccaccttctggttccggtcctggcccttcgcgtatctcccctgctctgcaaactaatgcctctgcctctctctgtcacccaccgcctgtggcctctaccccgcccttcctggccccagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccccacccacccccccgcagattcccccatgggaccctgtcccctgcttcaggaaccagatgggcaagcatcgtgccccttcctccccccaccttcttcttggaattcccatccccactgctgtctcctctggactccagcccctgaattaaagagagctggagccctaggtccgactaaaatgtgggagaagcagagcttggagcttggagcttggaacctggatcctcccgtacccgcactcccacttcccaggcaccctggagcctgccactactggagaggtctccaaatgacatcccaaggacctacctctgtcctctgtgagcacaaacagagatgcagggtgcctagggctcagaggaccagacgggggcaggacccagcctgcctagttccctgtcgtttgttcccttgctgtggccattgctgccatctcctccactgcttgaaggcctcaccccatgccctctgccactcccatagtgctctgtaaatattatcaggaggaaaaggcctctcagagtgcgtgttgctgtgtacaaaggaatttccatcaataaaagctgatctcttctctctgtctgatgtatattccacccacccccacttccctcttccaatccccaccagggccttgccttctttcctatccagggctgggaataggggccgggaaagagagtagggtttgattcgtggttttgtcaacacccaggaggcactcaataaatgcatgaatgactcccaacacgggcaggctaaccttggatgtgtcgcatgacctctttgacatctataaaaaggagaagggttggattagagggtctccaatgactcttccagctgtgacattttgtgaatctgagatgctacagttttaagaagctatgattatgtgaatttaatagacaatgattcagtgacacattccactgcaattttatgatttctatttctacaatgcagtgattttgggattttccagtcctgtggttttaagattgcataattctaccatttgaacaaattctgatgatgcaattttaatattctgcaatgtttagattccttgatcgtttacttttaaggttctgattctacaactttagggatctctgaatctgagaggaagccatttccctccaatgcaacgaccctaaatattccctgcacctgggcagaggctggttctaagactccctggaggctctcagctggagggtggaagatgtcctttacgggtttgtaggactcacaccttccatgatgtgtctgaagtgggctcatacccccgacttttcctgtctgagcctttggtattagacaaatctgagtttaccttctggttctgccacttacatctgtataaccttgagcaagttttttcttctccttgagctttgttttcctcctgagtacagtgagaatatacctacctctctgggttgtcatgaagattagcaagaaagaacacaacgagcccagcataggagcttgtgcactgttgggcaagtgtgctgtgattggtggctcttgttttgattaaggcccaggtgagagttttctcctgtcttttctttcctccctcccttcagcatctctatcacattgaacctctaggtttcctagaacctcacctccttccctcacttattgcctcactcgctcaactcatctactcattcacccattcaaagtctcatttatttctcccctccctccctgcctgtctcccttatttactcttcctcattctactcaacaaagcattgtttgagcccttactgggtataagacctgacgctaaatactgtgagagatccaaagtaagacagaggccaggtgtggtggctcacacctgtaatcctagccctttgggaggctgagacaggcagatggcttgaggccaggagtttcagatcagcctgggcaacatagtgagatctcatctctacaaaaagatttttttttttttttaagcatgacagtggctgtgtcctctgcgagctctccatctcccaggggagatgagagatgagaaatcctttgggaaagtaggaaggatgcaaagggttaacatgattggacaggaacggcttcagtaatgagcacattttgttcctggcccagagaggaaggagatgtcaaggtgggtggggaggtgtggtgtccaggagggcttgctggaggaagaggtgcaagagttgagccttgaaggctggtaagggtttgaaaaggtggcaaggggtgagaaggcattataggagacagggaccgcatagacaaaaacctgggggagcgctccagggtcatgcaggggaatggtgggtacattactctgtttattctgctctccagggtgtgtgaatgtaggtgacctggggctggggacgaggagaccattctacccttccgctgaatggagagagaagcaagtgtgggggtggggacgggggttcaactacatggggggagggggcaagtcagggtcagatgaccctcccgacccgtgggcaactgaattggctgaatcgggcagagggcttgtgctgtgggaagggggtggggttttgatcagccgtgagagaaatatgtgtgcacgcatggcctccatgtggccggccatcctcacacatgtctttgcacaaggctctgcaggtctcacagttgtgagactgtgcacactgctgcagagctgaggaaatgtgatgatgtgagactgggtgtgaggaattctgagtgtgaggttgattgtgtgaagtggtgactttatgtacctggcagccttgatgtctgtgtctggtggatgtaatcacaaggctgggtgtgggtggcttttaagcacgtgaggctgtggcctttagggtgacagttgtcaggcaggatggtcacacacacacagacacacgtgatttctacctgtggtcttcgaggacccagggtggctgctgagtaactgctgtgtgcttagtactggcatgagtgccataggtccgcaaaggtgaatcacaccgggccgctgcccttgggaaacaggacgggggtgtggggtgggagacggacactttaagagagaaccacaagttagccaggaagaaagactgactgtgataatatgggtatgcataagacacaggggagggagtcactgaccctgtcatgttccgtgagcggcaggagtgagtcagcattgacttcccagaaggaccaacctgcccagggtactgcaagatgaagatgagctcacccagatcaagcaagtcggggggtgaaggggagacagaagacattctgggcagaagaaacaaaggaagagtatgagcatgggcttggttatgtggatcagcttgctgtagtctaggaattgcaagtaacctgctattgcctgtgacattgaggaacttacagggcagggtgggaggtgaggggtggggagacaggccagattcagaggggcttctgaagctaagagtgggatgctggccagaggtgagggggattcttgtcctgtgcaaccctgggcaagtcactttgactctctgggcctccatttgggtctgtgggattggatggttcataaagcctagtccgtccagtccatcccagctctgtgcatcttctgccacccttggctagccacatccatgagtcatcgctcttgaggtcaggagcttcttccatctaacctcagtccttcctgcttcctcccgggttgcttcctcgttcacccactccacaaatatttacccagcatgcgatcctttgtgtgccactgtgggaaggcacggggagatgaagaatgcgaggactgtaccttgaagggactgcttatagtgcctgggacagagggtggggtggtggtaagagcacgggctttgtgttcagatacacttttgtttgaatcttggctccaccagtgctgagcttcaaggctttgggcaggttacttcatctctctgtacctcagtttcatcatctgtgctgtcctcctcagagagaacaacccaaaccttgcagtgttgctcagcctagcaaaatgacaactcaataaatgacaactattatttttagggctgcacagcagcaaagctgggattcaagctcaggtcttgcgctcccaaagcccgtgtatgcagctcagctcctctgaaggctgctttcttccctgtcagttcctgtgccaagccaggctgggctagggcttagatccctgtgacactgggattgggcagcagaactagcttgcagaagaaatattggagggagaggtggctgcagtccccctgcctcctctctcccctgccactgggtccagtctcctggcccagtctgctccttccagaacccaaagcccctggtcccatccaggtgcaatgaccttcctcgtcttgttttcttgtctctacttccagtccgtcccgttccccccactgccacctaagttgtcatggggatagtcctcaccatccctagcttcctcttgccctcatcttatgatatccatggcaacagcccccattcgtttccatgacaactgcatcctgatcccatcccctgctggctgcctggttccgggcagtgccaataaagggaaggagggagagaagacctcccattagaagcagcatttgaggaggattagtgcccctgccatgggcaggccagccccagatccctgtggaacatcctacactgcttctccccatcttagtgctttggcacacaaggttccctcactcttcatctctaccaactccttccaggcaagacccagtccacaagcttcctcccccaggaagccttccgggcagcagaggaactagcacaagctttggggtttgaatctctgtcctgccacttgctagctctgagacctttggcagtcatttcccctcttggagtttttttcttcatctgcaaaataggaatcctaattcttccctcacgtttgccatgcagattaaataatgtgtggaaaatgcctgacacagggaaggtgcgcagtaagtgcgagtttatttttattctgctcaaccacccccaaacagaagggatctctctcctgcactcccccagcacttcctctgttccccagccctgataactttctgctttgtactgtggttatttgtgtagcatagcttatttccccctctgcagaggatgctctccaatttcccccacagaatagcccagcagacagcgcacatgggcgtgtgtgtgtgtgtgtgagtgtgtgtgtgtggttgtgtccgtatatgtgcatgtctgcatgtgtttgtgtctattttcttgtgtctgtggatgtgtttttgtttctaggtttgtctgcctttgcatgtgtctgtgttattgtacctctgcatgcatgtgtgtgagtgtatgtgtgtgtgtgtgtgtgtgtgtgtgcacatgcagatgttttgctcctggctgggaagagtccagagagggggtgctcccagaccgtttctgaagtccaggaatccaaagagggagttggttttgcttgacccctgcacagatgagaaactgagttgcagagaggaaaagtgacatgcacgggctcacacagctggtcagtggcagtcaggacctgagccttggcctgcccagcgtcttactctacaacaggctctttctctctctgtgtgtttgcatgtgtgtgtatgtgtgcgagagaaagagaagaagagagattttccatgtgatcagcatgtccccgagtgttgttctgggggctctgacttgagggattccacatccccagtgctgtttcttcagcagtatgtatgatgtcagaagcaacgccgtcaagcaccctcctttttttgccaggctcccttgtgggaggctgtgctgacagcctgatctccctgccactattccctttgcaaccaaaacgggggtgagctctcaagggaggaattgccaaagagtgcagagccaggggcagcacggagccgggagtgaggagaggcaacaagatgtcatgaaaagcctgggccctgggtttgaatcctagcttttttacttaatagctatgtgaccttgagcaagtttatgtcacctctctgagcctcagtgtcttcatctatgaaatgaggctaatggtgcctgccttggtaagtttcaagaattcaatgagctaagtagtgcctttgccctaggaattagaggtgacaacagggccctactgcagcccgagaggagcgggtgtaagacagcctgtgtggaggaggcaggcaggcatggaaaggcatacctgagcagagcattgaaggctgagcaggaggtagccaggttggggcaatggggcagagaatatatgaggtgggggtcaagtcaggagagccatccatggccacagtgaggaagttgaaggttatcccatggctgctgattcctggaacacccaagttagatcatgtccctcctctgctcacctcaatcagagcaaaagccaaagtctttattgtaggctcatgccctttccgatttggcccccatgacctctctgatcttacctcctatctcctctcattcactctgttccggccacactggcctcttcactgtttctcgaacatgccagacacagttctacctccgggcctttgcgctggctgtaccctctctctggactgctctgcctttgccatgcaacttcctctcacttccctcagcactctgcttatatgccattgctccagaaaggccttccctgagcaccacttctcaaacagcaccttttcgcaatctgctatattttccttcctagcacttcacccctacctgaaatggcaggatatatttacttgtttctttcttctgtaagcctccaaccttgtgccccccataatgagaccattctctgggtcccagccacacccattccctcactagaacatcacctccctgagaatgttctcgtgcattttgctcactagtatatttccagcacccagcactgtgcctggcatacagagggtgctcagttgttgtttgttgagtgagttatctggcgctgtggaagggttttagtgagagaatgaaatagttaggttagtacagttttgtttttgtttttgtttttgtttttgagacagggtctcactttgttgcccaggctggagtgcagtggcaggatcacggcttaccgcagccttgacctcctgggctcaagcgattttcctgcctcagcctccctagtagctaggaccacaggcatgcgccaccacgcctggctaattttttattttctgtagagacggggtctccctatgttgcccaggctggtcttgaactcctgggcttaagtgatcctcctacctcagcctaccaaagtgctgagattatgggcctgagccaccatgcctggcaatacttttttttttgagatggagtctcactctgtcactcaggctggagtgtggtggcacaatcttggctcactgcagcctccacctcccgggttcaagcgattctcgtgcctcagcctcccaagtagctgggactacaggggcccaccaccacacctggctaattttttgtatttttggtagagatgaggttttgccatgttgcccaggctggtcttcaactcctgccttaagtgatccttccatgtcagcctctggagtagctgggattacaagtataagccactgtgcccagctagatttgtacttttttttttttttttttttttttggagacagtctcactctatctcccaggctggagtgcagtggtgcgatgtcagctcactgcaacctctgtctcctgggttcaagtgattctcctgcctcagcctcccaagtagctgggattacaggcacacccaccatgctcagctaatttttgtatttttagtagagatgtggtttcatcatgttggccaggctggtcttgaattcctgacctcaggtgatccacctgccttggcctcccaaagtgctgggattacaggcatgatccacggcgccaggcctagatttgtacttttggtggtggtggtggtggtgggttttgtttgtttgtttgtttgtttgtttttagacggagtctcgctctgtctcccaggctggagtgcagtggcacaatcttggctcactgcaacctctgcctcctggattcaagtgattctcctgcctcagcaggagatttcaggcccccaccaccacgcccggctaatttttgtattttcattagagacgggttttcgccatgttgcctgggttggttttgaactcctggcctcatgtgatctgctcgcctcagcctcccaaagtgctgggattacaggagtaagccaccacgcccggcccagatttgtacttttgaaagctctcactggccacagggtgaagaatgggttggaagaggagatcggaggctgtggtaaaagttcaggagagagtatttcttagagcagcctcctgagcacattcattgactccctctggacggcagcttttattgagcacctactctgttccaggccgtgtgctctgtgttagctgggagattatcaaattctcttcctgagctgggattctgggagtcatgaacacaaatagctgtcatgctttgccaaagctaacctgtgccataaaaagcaggacagacatgtgctgtgtgtgggagctctgaacaggatcagcaataatttctggctggaggcgggattcaggagggcttcttagtggtggcatatgacctgaatcttgacggaactaggatgtgggggaatttctcagattgcagatggcggagacgatggggattgcatttcaagtggtaggtactgtatgagcagttttggaggtagaaagcagaggagcatttgggaaaagcaggatgtgggccaggctggaatgatgggtggatggaatagggggctggcagccaaccctgaagtatggcttaatgtttaagagtgtgggctctggagtcagactgcctggatttgaatcctggctctatcattagtagctgtgtgaccatagatatgttacttaacctctctgggcctcagtttctttatgtgtaaaatgaagataaattacagtacctacctcatacggttgtcttgaagagcaagcaagttattcagtgtgaagtggtaagaatggtacctaaatgtgctaaatggtctataaatattagctgttgtatcttggagaagcctcaaatgccagaataagggacttgggctatctcttctgagcagtggaagttatagatgatggttcatgcatacaggagacagttgatcaaaactgggcttgagccgtgtgctgggaggggaggtttgagagattaatgggcaagatcctgcagtcctggcagggaggagaggaacatcttggatgccgggggtgggctgagctggggctgaaccctggagtgggggtgatgtcagggccaccgccccaggcccaggaggagagagaatttggggtggagagcgagcgatgggtgggagctctccccagggcggagccgagctccacagcgctgcagcccgggaccgggcctcgtgggcgcagccttcacaccacatccagcccccagtgcaaagcgctctgctgcaaggctggcaggcctgttgcagttccagctcctgcactggtagggtcccccccagtacctaccccagcccatttctgccctttgcctttgcctctgccgaataggggctggggagtaccccttcacctgtttaccagccaagagcctccaaccttgtgccccccataatgagaccattctctgggtcccagccacacccattccccccacagcctcctccatgcctcacctgcgtgttccttcccgcccgactccttccctgtcttccccacctctgtggctcttcaccgtgcaggctcggctcaaggcgcctgggctctgtcgccacctgggttccctggcagcctggttgccatggcaccatgggagcagttctggtggaacaacagctctgggaaaccagggcaggcaagacccggggcccagctcctgccacgcgtggagactcccctgcccccttcccccagctgagcagaggaggccatgaggagaaaaaggaagctgccccgcagggctgctctttacctgtgaggatgctggatgggaggcgcctcccactgttgctgctcgccctgccctgctgctggccctgccctcgcaaccagggaaccctgggaactggcttggcctggcccggagtccaggcaccagggggcaggggccaggctgcaggggacagggctgggcggatgaggggagagctgtgtgcaggggtgggcctcacacagctgggacagggctgggagggggtggcgctttgaaggagctagtctggggtggtgctgggaatcggactgggagggaaatcacagcgagcactgcgttggggacaaggccaggaggggatggagctgtaaggggaagaggtctgtggggaggggtggagctgtgagggggcagaagaaagggcatgaggagacaagactgggaggagagtggtctaggggagaaggctgtgaggggtgaggaggactggggaccaggcagagccttgagggaaaggagtctaagaggatcttgccgtaaaggcaggggggctggaagggaggggacttgggtgggagtggggagacgtccaagagctaggactcaccgtggcctgtaagtgttgggtccctatatctgtgaggaagctggggtggatgggatggggggcagggatctggctcacccactctcagtatggcccagtaggcccctgtcctgtccccacatcctggctcatcttatctcatccccacagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtgcaacagaggcatctggttgggaatgggagtcgggatgcaagagagcgccaggggagggtttgggatgtggctcttgggggtggtatcagggagggataatgaggctggaattggagaagactggcccaggacccttcaccccactggggatgcactcattcaccacccatccactgaggcttgtattcactcaagaaacatttactgagctccctgcccgggtcctggcgatgtaaagatgaatgagtcctggatccagtccccaaaaaactcagtctaacaggaagaacacacatcagttgaccttttcagaagagtgccatacaatagattgtttggctaaaaagaaaggtggagggaaaacaaaatactacatataggaaaaaactggaaggacatatacaaaaacatataccctacaccaaaagacatattctagttatgcttaggtgtttggaatgtaggtaattcaacctacctacctaccttccttccttccttctctgcctttctctctccctctctccttctcctttctcattctctttcttcctcctttctttccttcttgctctccatttatttctaccttgctttctttttttttggcttctctgtttgtttcctgttttcaaataatcaatatgttcttcttgcaaataagaaaacaaaacataatccaatcccatttgactagtgttatctgaaattcaagtgaggagacaacactgagcacctagcctggcgctctcggtggctgtaagcagtcagccatgattccagtgggggtggtgtggttgagtgcctagggagatgaggctgccatgactttctgaccttgttcccctcgacccttctctgccaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtcaggatccctgaaaaggacctttcttccccatccccgtgttctggctactcctgctactttttacctagattgcaaactgaaagaagttgcgtgacaggcatttaataacagcaaatagctaccatttgagttgggactgtgagaataatgagaaagaactggtaagatagaaattaccttttttttttttttttttgagacggagtttcgctctcgacacccaggctggagtgcaatggcacgatcttggctcactgtaacctctgcctcctgggttcaagtgattctcctgtctcactctcccgagtagctgggattgcaggtatgtgacaccacgcccggctaattttgtatttttagtagagacagggtttcaccatgttggtcaggctggtctcaaactcctgacctcaggtgatccacctgccatcacctccggaagtgctgagattacaggcgtgagccactgtgcccggccagaaattacattgttaaaacaagcaagttataaatatgggtgttccatgtcgttcccttcttgtgggaaaaaatatgtatgggtgtatagaacaaataagaaaaaagttctcactacttggaacttgatctactataaaataaagcttaactcacaggtagtgagctcctactgtgtgccagtgctgtatatgcctcacagcagacctgtgagacagggattattattcccatttaatagaggaggagactgaggctaaggacctggaattggtccttgtcctcaaggatcccagggcagtgggaaatggcagacatatgtgtgcattactgtctcctgaagtagagtgtgctctgagccatgagaaaggctatagtataatgtatagtaccttgggaacccagaggagggggaggaaactttcttctgggagaaccacagaaaacctgtttgagaaaacagcattggagctggaccttaccagacagaaaagatttagcaagttagaaatacttgggagggtgttgcttacataggcgttgcatcagcaaaagtgtggagggtggaattgtaatgcagtaaaggtagtgggtgatcgttgtaggcttggggtgtgtcaacatacttgcccaggtgtgaatcccagttctgccatttcccaactgtgtggccttggcaaactgtttaaccacactgaaacatgatcaataaaatggagagaaaataaaatggagagaaaacccttttagagctgtttggaagactcggtgcaactatacaggtaatatatatgaaaacacctagcacgtagtagctgctaagtacgttagttttcttcctaaaaccaagaaggtacttggtagagattgttgaatgaatggaagaagctttataagagaaaaagtcaccctgctctaacctctatgatctggccttgccatcagcctgggcatgcctccttggagctggtgaagaggtggagggaaggacaggagtattgaagggaagatctatatcattcgtctgttcattcatacaacaaagatttaattgaacatctcttctgtgtcaagcaatgtgttgagctgagctaaaaagagagaaaccaggcctggatccctccctcaagggaggaatgggaaataggagatcagtctgggaagcaggtctggtcccagctctgagtgctattgaagtctgatggggaagtatatctgttatctgttgctgtgtaacaaattacccccaaatttggtagcttaaaactgacccaagagagtgagcctaaacaataaacatttattatttcatacagtttctgggtgccaggaagctgggaatggcatggctgagtggttctggttcagggcctttcatgaggctgcggtcaagctgtagggagagcccgcaatatctgaagattagactggggctggcagtctgctttcaagctcacccacttggctgttggcaggaggattcaatgcctcaccctgtgggcctctccataggactgttcgtgatgcggctttccccaggttggggggtctgagagaaatagtacaagtgacaagcgaccaagagtgctcaagatgcaagctgcagtcattaaaaaaattttttttaatgttttaaatttttaaaaaatgttttgcagtttttttttttttttttaataaattttttttggccaggtgtggtagctcatgcctgtaatctcagcacttcgggaggccaaggtgggcaggtcacctgaggtcaggagtttgagaccagcctgtccatcatggcgaaaccccgtctctactaaaaatacaaaaattagccaaacatggtggtgcgcacctgtaatccctgctactggggaggctgaggaaggagaatcgcttgaacctgggaggtgcaggttgcagtgaggtgagatcgtgccactgcactccagcctgggtgagagcaagactctgtctcaaacaaacaaataaaaattttagagacagtatcttgctctgttgccaggctggagtgtagtggcgtgatcatagctcactgcagcctcaaactcctgggctcaagtgatcctcctgcctcactctcctgagtagctgggactacaggtgtgtgccaccacacccagctaatgtttttattttttgtagagatagagtctcgccatgttgcccaggctgctcttgaactcctgggctcaagggatcctcccatcttggcctcccaaagtgctgggattacaggcatgagccaccatgcccagcctctgcagtcttttaaaacctaatttcagaagtgacatacattcgcttctgccatatgctgtttgtcacacagactaactctggtacaatgtggtaccctagggtgtgaataccaggaggcagggatcattagcggccagtttagagtctggataccacagggagagagcattaccagctgtggtccagatgctcaaggtcaaatgttatggatttcctaagagaattcccacagaggaaactgggattttggtttactctgggggatggcagaggcaagaatgtggcttgaatcagggaggaggtaacgtttggcttgagtctaaatggacacaaaggaggtattggggtgtgagctgagtggggaacttgtgggcattagtctcagctcctgtgagctcacaatggttccctgggagtcattttacagaccacagagagcctgtcagggctgggggaggggaatccaccctccttgctgacctaccaggaagactccccctttttccttacctccctccctcattcccaccttccaccattcttccctttatctttctttcttttctctccctttccctcctctcctcccccccttgcacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagtgcgtgctccccgttctagcctgcttaccccttcctaccctgccacatgcacttgggttcctgggacagaactccacacagtgatccccgttctgccatcctttcattttgtggaatggtatttctccccagacattcagggaagaggattggcaacagggtggcagagtagagagtcccttaacacacctgggctcgggtcccagtactgcccctggctggctgtctgatcttgggtgagatgaccccactaaatggattctgaaccttgtcctccccaccttccctttttagaggggaggtgatatggtgtagaaagagccctagtctgggaaacaggagacctggccccctcagtcggcctttggctagactcactgcatagccctgggcaaggtgcattcctcccctgggcttccatttttccacctaccactagcagaatgtgtatgtaagaggtgttgggggcagggtggtgtgctggacccttcagtgactgtgactaagctctttctaggtgcctggtcttctgccaggtgtttaggagtgaggtgggagtgtgacatttgattagaaaataattggaaaatattagatgtaattggaaaacattagatgtaattggaagccattacttgaatgccttacatctttatagcttattaaacactgccacctatatttaattcttacaataactcagcaaggcaggcagtagtgttcctattttgtagataaggaaccaaggcttggagaagcaaaaggaattgtccaaagtcatacaactgggaagtgatggatctgagactcctatggcatcagtcccttccaaattttaaccttgtggggtcctaaggttctggggttctgaatatgggatagctgtgacccagattttggcccagctccctggaaatctagggggcaccttgtctacagaaacactcagagaaagttggtgatacctgcctgagtgggatgtgggacgtggaacaaagtaacctcttcacttcttccctactctgagggtctgtgactcagagggaaggtgctcagccctctcctcggttcttgctgggaatgtcaagcctggcatagagcaggctctcattagatactgattttctttcaattgtgatgtggctccagtgaagggggatgttgggttgaagataccttgggattttgaagctccttgaaatgggcaagtggcttcttctccctgggcctcagttttctcacttgtgccatgatgggattggatcaaattatgtatttgacttcgttggtcctctgaggccggacttagttgggcccaaaattagttcaacaaatgagacagagagcacagttccaggaggacagtcatctcatctacctctcctctttctgcaggaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggagtgaggaccccaggatggggcaggctgggccagggattcctggaaaaggacagcaagagggaggaagggggcagcctgtccctttagctcagataagcttttcaaaacaggatgaatagaccttcctgcccctgtacccttctgccccaaaggggtctgatcttgtttggctctattcctaaagtcttctgggtggccctgggcaagacatgctcatcctgtagcctgttttgggcctcagttttcctgtctctgaaatgagtggcttgatggaaaggacctttagtgaccacgtgccttgcctcaattttctgagatggatttgatttcaaacattctgtcctcatgtgtacttgctcgggccacaggtcctgaatttgagagtctatcagtgggggtgttggtccatttgagcaggtccaggtgggtcagaggttttctgcagaggaattgaaagcgccacacctccttctttgctccttagctgtgtggtggatgagatggacttctcctccatggatctggatgatgcgctccggaagttccagtcccatatccgggttcagggtgaggcccagaaagtggagcgactcatcgaagccttcaggtgtgcctacctcccactcgcgaagctgcccctccctcctgtgggcatcgacgtagtatgtgtttataagtcacttctctgagcctcatactttcttcaccataaaacagagatgataaatcctatcttgcaaggcaattgtgaggatcagaggtagtgcatataaagtatctagctcagcctctgggacatgggcattcgataagtgacaacaacatcagcaataacagctaacattcacggagcacttactaggtatcaggtgcagagctgagcactttacatgattatttcaccgaataatcacaaccaccccataaagtaggcacttctgttattattcccattttacagatgagaaatcagaagtttagagaggttaagtaacttgcccaggctcatacagtgaataagtggtagaaacaggatttgaactcgtatgtgtctgagtccatgatccatccatgcccttaaccattttactgtactataaatgctttggagatcagatagactggggtctaaatcctggctctgccactttagggtatttagaagagaaacaggagttgctgagaacttgtttcccacaatgggggaaggatttgctttgcagtcagaaataactgggttttcatcctggcttcaccatttaccagctctattaccttgggcaagttacctcgccactttgagtcttagtcacttcatctgtaaaatgggactgccaatagctaccttgcaggattatgataggattacgtgaaacaacgtacataaatcccctggaagagctctgtaaaaggtagcgattgtgatttttacatgctggtctaggggaagctctgaagaggacagacccagagatcaagaaagtatttcttgcaggaaagggttgctggtgccagactgggtggatggtgggtaggcagagatggctggttcctgagtctggctttgacccctcctgccctgcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggtgacttccctgtcagcttttcctgcccttcacctggaaagggaaagtggggggtaaggggaaggatgcaggagatcccatctgttccttggaaattaatttgtgatgctgtcactttctgccctagctggatgttcccaggatattcacttattaattcactcaaatcgtcatttgcccattgtactgagcttctactgtgtaccaggtttctaggtcctggggttcaagcagtgaacatgatagattaaagtcctgactcttacaaggctttactctgattcattcattcattcattcagtaattcacttgtcctttcctcgctccttctttccctctcttatttatgcccatgaggactcatttaattattttaggtaccttttcctctattcatgcattcatttatcactcgaccaaacaaccagccagccagtcaacacttagcgcttagtgtgtgccaagccccatgatgggtgccaaggacaatggaggggaatctgccatactccctgttctgagagagctccctgtgtgtgggagaggctgacttgtagcacccagataactaacataagacagaaagtgaacagtgacatcagagaggccaaaagtgcagtcagagctcaaaggagggagagcccacctctagctagcttcctggaggaggtagtatttttattttaaggtgggtcttgaaggcatggagaaggtgacacaatagagatagaggagggcttacctagcaatgagaataccaaaggcgcagaggcaggaacatttattttctttagggaacaattgagggctgggtacgttggctcacacctgtaatcccagcactttgtgaggctgaggcaggtggatcccatgaggccaggagttccagaccagcctggccaacatggggaaaccccatctctactaaaaatacaaaaattagcaggcatggtggtgcacacctgtaatcccagccactcaggaggctgaggcaggagaattacttgaacctgggaggtagaggttgcagtgagctaagatcgcaccactgcactccagcctgagtgacagagcaagactctgtcttgaaaaaaaaaaaaaaaaaaaaagaacaattgagatgaggtcattgatgggttgggaaggtcccaatatatgaggttccaatatatggaaccaatatatgagggccttgaatgccagatgaaaggtgtcaccttgctctttttgcttattctactgatgtcgagccctgcctatcaccaaagagcagctactaaaaatggtacagatgttaagattatttaagcagaaaagaaagagggaaatagagtcaaagaaaaaaagcaaactgaacacaagacaaattggctgcccatcaggtttgtgccgctgtggctgctctggtaagaaagtcagtgcgatgtagtatgttcctttagcacctgtccaaggaggagatgtgacatttccaaggaagaaaacattttttttgttttctgtttttttattttatttgttttttttttttttatttttagagacagggtctcactctctcacccaggctggattgcagtggtgctagcagagctcactgcagccttgaactcctgggctcaagcgatcctcccacctcagcctcctaagtagctgggactataggcgcgtgccaccatgcccaactaatttctaaattttttgtagagacagggtcttgctaggttgcccaggctggtctcaaactccttgcctcaactcggcctcccaaagtgctgggattacaggtgtgagcctccacgtcctgcccagaaaacattttctctagtagaggatttagagagaagagtgagtgggtttcactcagcaatcagaagtggagaaggatggtgaacatgggaggagggagttagatcagaggccatttggagctgtctcctagaattttgccatcattcattcatccattctttttccctctctctctcaatatatgtgtgtgtgtgtgtgggtgtgtgtgtgtgtatgtgtaacttccccctctaattattaaataaataagcaaataaatgaaggtaatacatactttatttcagaaatgttggaagattcagaaaattagaaaatttctttttatcacccaaaatgtgccccctagaggcaatcatagttaatgttttggtgcgttctaatcttttcccccatgcatatgtaactttttatatagttcagatcataccacacatgcaatttatcttactcttttcccataatttgctactgtaattttctcatgctattgaaatgtttttgtaaatgtcaagtttttaatagctgtgcattatcttattaaatggatatactatcctctattgttaaaatttaggttgtttcaaattgtccccataagtaacacttagtgagttttttttttttttttttgagacagggtcttgctctgttgcctaggctggagtgcagtggtgcaatcatggttcactgcaacctcctcctcccaggctcaagctattatcccacttcagcctcccaagtagctggggccacaggtgtgtgccaccacacccagctaatttttgtattttttgtagagatgggattttgccatgttgcccaggttggctctcgaattcctgggctcgagcgatccacctgcctcagcctcccaaagtgctgggattataccacgcctgccctagcattcttttttttctttttcttttttttttttttgagacagagtctcaatcttgttgctcaggctggagtgcagtggcgcgatcttggctcactacagcctctgcctcccgggttcaagcaattctgcctcagcctcccgagtacctgggactacaggcacatggtgccatgcctggctaattttttgtatttttagtacagatgaggtttcaccatgttggccaggatggtcttgatctcctgacctcgtgatccacctgcctcggcctcccaaagtgctgggagtacaggcgtgagccaccatgccccgcctgcactagcattcttgcacatacctcttgcacatatttctgagtagttccttagggtagattcctagaagagaatcactgggtacaaacatttaggttcttgccaaattaccttccaaaagagttatgttaccatacatgcccacttccctgcactcttcctagcactggatttcattttaaattatttttgctaattaggaaggcaaacaatagtatctgattgttttaattacagtgtattctgagttgttgagaaaaaattccccactctggggaagatagcaactggctgttgtactgaaggacaccctccctgccccaatcctggctaaggggccgagggtacccattgaccctcagtcctgactatcgtggcccgtgcctgggtgtgggggtggtggagcacccctaccacccagtgcccataattatgtgacatatccctgtgttactccctcccccaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtaagtgccttgggaggctgcagaggggccagggttcaggtctgcctctgccactaagtggtaagtcactgcacctccctgagccccaggtgccctttacctgcaatacagagtgggtgataatgcattcctcagaaggctgtggtgcagagtgaatgcatcgagcacattccaaggcccatagtgggtactatataaatattagcatccttttcacctccggctttgcctgtccatcctaagtgaagagccaagctaatggttagcagaaaaccaaagtaagaacacactttaggccaggtacaatggcttgtgcctgtaatcccagcactttgggaggccgaggtgggtggatcacctcaggtcaggagttccagaccagcctggctatcatggcaaaaccctgtctctactaaaaatacaaaaattagctgcgggcgtgatggtgcatgcctggagttccagctactcaggaggctgaggcaggagaattgcttgaacccgggaggcggaggttgcagtgagctgagatcgtgccaacgcactccagcctggggccacagagcaagactccgtctcaaaaaaagaaaaaaaaaaagaaaacgctttagccaacaaacatttgtggatgcctttccactgagcccagcatttgctgggcaccagagttggtgctgggcattcatagatatgaatcagacgtgttctctatccttgggggcactcacagaccagtcggggtgtgaaacaaagacacatataatacttctgctttatggtccagtttaggagaggagaaaggagagagagaccattttcagcctggagaaatcagggaaggcttcttggaagagatcattttgggattgaatttttttttttttttttttttttttttgacatggagtttcactctgtcactcaggctggagtggagtggcatgatctcggctcattgcaacctctacctcctgggttcaaacgattctcctgcctcagcctcctgagtacctgggattgcaggcgcccaccaccacacccagctaatttttgtgtttttagtagagacggggtttcaccatgttggccaggctgatctcgaactcctgacctcaagtgatccgctcgcctcggcctcccaaagtgctgggattacaggcgtgagccactgcgcccggccgggatggaaatttgaaagggagttgaaatatgaccatgcagagctgggcaagaaagacattccagacagaagggcaaaggcaaggtagcagataagtttaggtcttagttgctgataccccttgtgtcagagtgacacacatgtatgagtggtaaacttcttgcggttgaaagttaaggtgccaggaggcctgaagctgatgggctggccttgctgacacctgtttcttcatgcctgtctaggtcctgtctctccctcaccgtcgactggtttgctgctgccagctctacgaggtgccagatccaaaccgcccccagaggctagggttgcatcagcgggaggtcttcctcttcaatgatctccttgtggtatgagcactgtgggggaggagatgggagggagagagtgagcttgacacctaagtctggtgtgaaccatattgatgtaggtgtgtggtgtgtggagtgtggcgggcgaggtgttctgccatgccatctgcatggtctcaggcaaggcccaggccttctctgcccctccttttcctcacagatgcatttggaggtagtaacagacacacagggacagaaaatatgaggaccaaaggagatgacagacttacaacctgggaagtggtaggaaatatccctgtccacctcaatagcccatagggttgtgtgaagaggggtgaacctgcgaccccccaggtcagtctggaaatcttcagtaatcaagatgcttgaagtgggctcggcactgtggctcacacctatagtcccagaactttgggaggccagggcagtttgaatcacttgagcccaggagttttgagaccagcttgggcaacatgtcgaaaccctgtctccacaaaaaatacaaaaattagccgggcatggtggtgtgcacctgtagtcccagctacttgggaggctgagtcgggaggatcacttgagcccaggaggcagaggttgcagtgtgctgtgatcgcaccactgcattccaacctgggcaacagagccagaccctgcctcaaaaataaataaataaataataaaaacaaaatttaaaaaagatgcttgggccaggcacggtggctcatgcctgtaatcccagcactttgggaggccgaggtgggtggatcacctgaggtcaggagttcaagaccagcctggccaacatggagaaacctcgtctctactaaaaatataagaaattagctgggcgcagtggcgcatgcctgtagtcccagctactggggaggccaaggcaggagaatcgcttgaacccaggaggcggaggttgcagtgagctgagatcgctccattgcactccagcctgggcgacaagtgaaactctgtctcaaaaaaaaaaaaaaaaaaagatgcttgaagtgattcttcaaactgagctcattacaagtagagatgtttgtcttttagggatgggactcttaggactttgcaggttggaagggactttcagggtccagcttcctagatggcccactggatgtatgactgcagggacagaaagccgccttcctctaaggcagccagttgccttgttaggcagctctgactgctagaatttgtctccctgtgggtttcttccagccatctgcactcaacccttggcatcacaaagaacaagtgttgtacctctgctccaagacagctctccagggatttgaggactctcttgatcctgttctccctgtggtcttctctcctttagagcagggtttctcagtctcatcactgttgacatttggggctggataattctttgcggggactgtcctgtgcactgtaggatgtttagcagcaccctggtctctacctactaggtgctagtagcaacccttcaaccaaaaatgtctccagatgttgctccgtgtcctctgggggcaatatcacccccagttgagcattgctgctttagccgaagtatttccatgctccctctgagccttagtttcctcctctgtgaaatggaactaacccctacttcacaggattgtcatgaggatgaaatgaaataagaggttatatgtggaatctgccctaccccagggagtacctggcccacacagtcaatgtgtagacatccctcaggtactgaaactggtgtatgtccagctctatgctaggcactgggtatgccaggatgaatcagacttagtccctgttctcagggagctcacagcccaaaggacctaaaaaagtgctttgcgtcattgtgccatcctgaaatcaaaacatttccttttacgagccacttgcagaccgcctgaggtgtttgcagcctgtgttagttgagtccagagtgcccaagtactcgacaaagatattgggttgttgagaggaagacttattaactctctacatgggttcagcagagattgccattaagtgcaggctctggtaaggcctggtgacagaacccgacaaccagactcctgccctccagtccagcagggggcgatcacacactcagaggactagcatagtgcctgacaagggaaaggcactgaatcaccattctggagctcagaaaaggggtttacaaatctctgtgggatgttggagcaggcttcctggaggaagcaggattcagttagtttctggaaatgtggtaaatgtctgtggtgcgtggtcattacatcaggaacttgcgttttcttccatgtctcccattctgtccctcaagcttccattctccccagcttgtgggcatgtgtgtttgtgtgtgtgtgtctgttaatggggtgggaggggagggtggttaccagaaataggtgccacgtggaaatcccccacccaaagcgctgcctcttgtctttttcccacccctgccaaaggtcaccaaaattttccagaagaagaagatcttggtgacgtacagtttccgtcagtctttccccctcgtggaaatgcacatgcagctcttccagaattcatgtgagtcccttcttggatcccagctcctgagagtctatgtcatggcccccatgctcacccgtcatctataccagctccagttttcggagtcccttacaaccggactaagggtctccaaagcacctacttggtcccaggatgaggggcaggccagggtggagtatgacttgggtctagcccctggttagctcatggtcttgcagagaaccacagtgcatgtgttctctggtgggccaaagagacggtgatcatgctgtgctctgaaggatgaaccaggaggagctttgttgcgtggtattcctggcagcagaagcaatgtgagttgaggcagaggtgagaaggaaagggtttcgagagagcagtgcatagttgtgtgcctttacatcctgcagtacagggagtaagagggccacagctaccaggagtttgagggctttggggcaaaggggagctgctaaacatgctcaagcagagaagaggcatgatcagagttagacagtagaaaaattatttcatgggctaggcatggtggctcacacctgtaatcccagcactttgggaggccaaggcaagaggatcgcttgagcccaggaattcgaaaccagcctgggcaacatagtgagaccccatctctactgaaaataaaaaaaaatctgcgcatgtggtgcgtgcccatggtcccagctacccaggaggctgaggcagaaggatcacttgagcccaggagttcaaggctgcagtgagccatgatggcaccactgcactccagcctgggtgacagagagatgttgtctcagaaaaaaaagagcagaaaagaaaaattattttatgtatgagccaccttgcaccagtcccaacagaggtgcccagtctcccctttctccacagattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtgtgagtagcccagccatgtctcctccctgctctcctgaaacagtaccctgcagaaaccaagaatcctatcctcagagaatctcagagttgagggttagcttgtccaaccttcccatcctcatttcaagaattcttcagcctctgcttgaataccttcagtgacaaggggctcattacctcccaaccccattattatcctgaactctaattatgagccaactattccttctagtgaaaggtatcagggagaagaatcagagtattggaggtaggactatagttttagatcccaggtatactactcattatctgggtgaactgcagcaaattgcctaacctgccaagccccagtttcttcctatacgaaattggggtaatgaagtctccttcacagagtcatggagatgaaatgagacaaggtagccgaaatgtcccaacacatcttaggcattcaaaaaatccgtatttcctgtcccaccctctctcctcctctgcccacatatcaattcctgagctgaatcccagtgggctatcctctcagcccccaggggccacaccaagtcattttgatcatatatatataatggaaaatagtgattacatctcattcctcccgatgccctccaagttttctcttctccaggctaagcagtcacagttaagtaacatggtgttaaggagaaagaggcaggcagacagagacgaggcggcggacagctccttggtgaggccttcacagctccagggccactctacttctcagcgaggcagggatagaaatttcagttcaccagatcctttgagaccctggggaaatcctgagagagggattagtagcccaagacgaggggaggccagtagacacgtgtttctatgagctccgtggggaggtggggctgtaggaggccggaagcacccaagctctggaatcaggcagacctgcttccagaatgtcggctctgccatttccagctgtatgaccctgggcaagctctaagacttctcggatactcagtttcttcctctgcacaatgtggatgctaatactgacctcagaactgttgtgaggactgagagagatcaagtatgtgtagcgcccagcatactgcctggcacataataagaggatttgattcctgtcagtttcctgctcctgcccttccaggagcccctctgctccggagcaaggtatctgagaactgactgaactctggaaagattgccctttgccataggctagaagggccttaccatccttactgtgaaccatctgccatgaagctcttttttgaagggcaggggtgctttgggagacctgattgcaagagggcatgggaggggagaagtcagaagggtgaaaggaagggaaagggaacagggagagcaggcaccaagagggatgaagggaaggctgagcaggaagggagggtgcaagacaggagctgggcactaagggtgcttcggtgatggagctgcagttttgggggagacaagggctggtcgtccaaggggcaaaacacgaagcctggggacagagggagggaggagggaggaggaaggagaatggcccatggagggctagggtcagtcagatgggctctcactcctgttcctgacctttgctccctgtctccccgactgccacccagcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggtaagccctctgggcccctgccctggctggggagacacgggaccgggtgtcctctttgcctcctgtcactggccgccagccttccctccacctgccacacatgcacgcaccctgccttcacccagagccctgggcgctgcgccacagggggcctgggagccaggtcagagcagggggagcccagcttttgggccagggagtgtgaagtggggccacagtcttggtccctctctctcgctgctccccctctcctcctcttctccctcttctgtctctcctgtacctccactcctccttctccatcttttcctcctctttctcctccttctccacctctcctcctccccgcctccccctcttcaatgggggaaagggataatggggtgtctgtccccgggaggggcccagtcctggtgcccagctctggagcccagcagggtagggggggggttgctgctctgacgctgggctccttgcttgtgggtgcagggaagcgggggcggcgtaacagcgtgggatcgctggacagcaccatcgaagtaagtgccagctcctgccccactcgtcctctgcatgagccctgccccggccatggagacccagaggaggaggggacctgttgctccccctcttccctgctgggaaccatgcggctgcctctcccagccaaccactctctccatctgtcctcaactctgtctgtcctcattctgcctgtctctcagtctgtcttccactctcccgtgccccctctcaaccccagggccgacggcgagtagggatgcccttggagttgggccacgagaagctcttacctccaagtcctgctctttgaccctgggcgagtcactctgcctctctgggcctaaccttttccctgcctgcaaaatggggatgaggaggaggtactgctaatttctcctctcccagctgaggctcagctgagatagtggatgtgacagccgagctttgcaagctggggagctccacatacgcgtaccggactgtgatttggtttttattacaacttggggtttgctgtctccccagctccagccctcagggacaggggtggaatttagggctgggggtttagggcatctagcctggcctgacttcccccctccccgcttccaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctc

SEQ ID NO: 3418 - DNA, 88463 bp, human
cggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaagtaaggaatgtgtgtttgtacccccggctcttccctctagatccctctccaacttgtccagctgatagagtaagaagccagtgtctggttccgtgtcttcctctcctgtcccaacccgccaggagaagccaggtccccctcatccagccgacaccccttccctggccaccccaggctgggttggccagatgagtgcaggcgtctcttctttcccggtaccgcggccagcgagggactagagcagtcatcgccgcctcccccgcctccacttcttcaacccctagctgcatccttgccagaagataggttttcatttatttatttattttgggtatgctggttggaatttttatggtcggcgagggtgtctactcagagccccaggggagagaaagccccccacccccgcctttttttttttttcctttttctttttgcctgatcttttctcctctggccgcctcagctccatcccttaccaaagaggcaggtggggaccagaatggctgctggaggctgagacatccctctgaagggaactgcagcacattctggccggggggagcaaagatgggggagcaaagatggaggccaagcccttggctagttcctcaaagtccaccccctctccacccttcaagaaaaacaacacccatttaaagagccctaccgggaagggaagtctagattgcccctctgctggatcggttccagttcctgcactggggtctgtgtgtctatttgggacaccttggcactatctcttgggttggtgggacatgggctgggtccactttttctgtgtagataccatggtgagctgattgggttacatgtatcaggctgagagagtcaagggcgtgcagactcccaaggctgccctaaaggctcccttatttcttttctgccgtattcgaaggaacactgagctgggagttgggagacctgagttccccttccagctctgctgcagattggctttgtgaccttgactgagtctctttctctcttaggccatcagttcccccgtatctttttaaatggcaaggtctgccttggatgatcttgaagtacccctccagctcagatttgatggttctatgtttaatccagccacactacagagcaagtctgaagtcctgtagcgaatggacaggcttccccctcctctcactgctcagctggtcctaccatgtgccacaaccagtggagtgtctcttggaggctgggctgggggtggggaaaccttctgcctcaggaaatctgccgggagacagctctctgcaactcccccgtggtgaggcagcaggctggggtgctgggttgagatggctgggccccaggagcagcagctgtagcttgagggctcggctgggctccactgcagcacaccctaagctgaattttagtgtggactgcccctgaggagtctgggggcaaaggaaatgggctttcctgcccaggcagggctgctgcgagctcagtccgggaggaccgactgtgtgccttggggcgccacactggaagagggacagaggtagaccaaggtccattcagggagggtcatggtgggccgggggcagaggaagactgcatggggtatggtcgagcctggctgcagaagacttttctagaggggtcaggcctgtgacagagggagcggactcattatgtgtggcttcagtgagcagaacccgaaacagtgggaacatttgagatagattaggaagaactttccaacctggcattctggtggtgcagtggactgcctcgagaggtggaggtgggagctggatggacctggagctctcagcggagctcgggtgggagtctgggagaactggaggaagcatgattcctgaatcaggtagaaagcccagtgaaatgacctgggtcgtccccagttatgggattccatgactctggctctccaccctgcagacattggtctgaatctcttggctgactggttgcctgtttgctcctgagctccatgtttctgctatccgtgcaggcctacctcttggtccttccctctttttgtgaacccccccaggttgcttgttgcgtttccttgctttgcatttcctactggattaataaaggggtttaggtagtactttaagtttctctcctgaccatatattaactatttgcacacccattattacctctttttgacttcacaacaagccttctgcagtgagtgttggcaactgcattttagagatggggaaactgaggctccaagatgaagggacctcactcaaggttaccctactagttgctaatggagctgggactagaacccaagtcttcctgtctccaaggcctggtatttttttctctagagctctccaacccacaggagtctcttagcctcaggacctggcctggcactgagctaggagaggccaggagagccttaggtctctagaggatttgagcaggaggagatgagtctgggatgagtggggagttgacagcggcagggaagaaggctctgtctccctcctttccactctccctcctggcctggcatcaggagggcctgttgatgcagtagccattgctgtcactgctgctactgcaagcgactcccctgctaggtctgttctgggtttgtaaggagtgggtgagaagccgctggaagcgagggcaggcagggtgggagtttagcagcagaggctgcagcattgggggaggctaggtagagcgggtacaggctgggctctcttggtccccaggctccccctggtggaggaagaggggagagtggtgcctgggccgagctgcagcttgttgggggggccccgctgtgcctagggactttctttagtcctcccaatgatcccgtgcttctgtcaccacgatccacattttacagcagaagaaactgggggatcagagaagtgaagcccaccagaggttacattactcataagacagactcccaatcctgtgaactttccctctactgcattggacatcagctgtcatgtccacccccatccatgtcatccacccaggattcccatatcctcctgcaccgtcccctctggacaggttccaggatgccagtatcccttctgctgtgctcagggtgtggcctttctagtgcagatagagtgagatgcgtccctgtctccttttggtcctgggtcctctgtacgcgaaggttttgtttgcttgctttttagtcgttggtcctgactaatgctcaggtctttttacctggaattgtccacatacccccccaagcctggttgattagagaatagctctgcttttgttgttgatcttggcttggcccccttgcagtcctgccacctagagtgatatataggagtgctaggggcccctgctgagttgctccacgctgaagagctgcgtttcccacgctctttgcatgggcccagctccggctctgctgtaggcggtggtgggctgaagctggtatggtggcaactctccttcctttacccccacccccatccaccctgcaagctggcttacacttggagatagcaactagaggggctggcctggtggtgttttttttctttttcttttttttttttttttggttttggtttgtttttgggacaggggtcttgctctgctgctcaggctggagtgcagtgttgcgaacatagcttactcaagtgagttcaggagtttgaggctgcagtgagcaataattgcaaaaaaggaacaccaggctggcccttctagttgctatccgcccaattcttttaagcagagacggggtctctctgtgttgcccagactggtctcaaactcctgggctcaagcggtcctccctccttggcgtcccaaagtgctgagccaccacgcccggcccaacgtggtattcttgacagctagggcagtgtatggtctaccacatgctgtcgtctgcttgcagtgggatgtcagcatgctccccgcaggggctaaggccactgagagacagcacgtgagacagtgagcccagggagaggctcagggaagtctctcctttggggtcttgggtacttttcccagggggtgtctctccttcccaggagggaaaaccatttatcttccctcccactgtgttgtgagcattatcttcgtgtgggaggaaatggtaatgttgaatttaatgagaatgagagtcttgcttctctatctagatctggggcaagaatggggttgttatcatctacaaacatttcttggctgtgtgcacagcgcaggaggggccacgaggctgagcaaacactgcactcttagcgcttgcagaacccctgctcccctccatccagggagacagggttgcaggcctagccatgccatagaggcaacactcaggacaaaatgagtggcaagaatggtgaggagtggaagttctcagaggaaggagggatcaggccaggccaggctgctgtttgagtacctgggcggtgggtgagggatgaggggtatggaaggaatgtgagtggtcccttcatggaggtggcagctgggaggaagacgtcagaccagacttgctgcctgccctttcctcatctgtcccacccctgcctaccaaggtctctgaatttgctgggcgcagagtaaaggcctggagcatggggaagaggccacacgtgtaccgagtgagtctcagccttctgccaggccccacgctatgtgactttatgtaataatagctaacattttttcactgctcttactgtgtgctaagcactatttgttctaagcgctttccatgtattaattcattcaatctccacatgaatcctctcgtgtagatattgttattaactccattttacagatgaggaaactgaggcccagaaaggttggatagcatacccaggatcactcaatgaataagtggcagaactgtgaaggagctggaggagcccagggagttgggcttcagggtccgcagtgttctaacccaccctggagcactacttcttacctcatttgcacagagcccctgtcagatgggtgtgttcgtttgtttgtttgttttatgagtttcactcttgttgcccagactgaagtgcaatggcacactcttgactcactgcaacctccacctcctgggctcaagcaattctcatgcctcagcttcccgagtagctgggattacaaacacgtgccaccacccccgactaatttttgtatttttagtagagacggggtttcaccatgttggtcaggctggtctcgaactcctgacctcaggtgatccgcccacctctgcctcccaaagtgctgggattacaggcatgagccactgcgcccagcctattatcttcattttttcagacaaggaaacaaggatcagagaggtacagtgacctgcccgaggttattcaggcagatggagcccagaactgtctggcttccaaacctatggtacaccgctgcctcccgcaggtgggctttaaagacatcagagctactccaggtatgtggctctagcttcctccaacagagctcccaggaccactgctctaggcaggctccctctcaccatcaccccctgaattttggccatggtctcctagtagattgcccctcctgctctcgctccatcaagcctctgatgaggtgcagccagaccatgttctgcagtccagctccagtagtttcactctctctttggcctgagaactcctccgcctgccctgcatggtcttcttaggatctgtccccagtttgcctttttcctctcgtctttgtacagactatgctccagccaggctgacccgtgtgcccccctggttagcccactcaggccttctgctagcctctaggtctttgctcatgttgttcccttctcttgggctgctgtacccagttcccaggctggactcagctgttacctctcctatgtctgtttgctggtgtctctgatgtttggtctatccttgaccctctcaatgagcacattgcccctttttattccttcatggttgtttacatctcatgtcccctctgttagactgagacccccttcagatttacatttaactgacatatactgagtgcattttgtgtgtcaggttctgtgttaggtgctgtgggcatgagtgaaggagctaaaagcttggaaacacatagcacagcacatagtagctgcttaataaatactgagtagataaatgaatgtctgattgagtcctgctgaactaatagccaaaggtacctaattttttcttccttccaggactcctgtagtaagaaatgacaacttcagaattctcttggggtaggcacagtagctcccagcactttgggaggtcaaggcgggaggatcacttgtgccagggaggttgaggttacagtgaactatgattgtgccactgcactccagcctgggcaacaaattgagatcccatccctaaggaaaaataaattcttttggcttttctgtggcttttttctcatgctccctggagccattttggcctttgctgtctcttctcacgctcaccagccttccgattcatagaatgtcaaggtagcagacttggacgagactttggagacatttagaccaatctgctgatcattatctctccctgccatgtcaggctgtggtcctgaccctcgatgccaagtcttctgttctgaaaggagcaaagaggcctgcacaggacctgtgtgcagttcactcagcccagtgggaagttgcttatttatccatcaaacctttcttgagctcagaccctgagctggacatggtatctcagggttgacataagacttggcccctctgcctcactcactgcagtgttccctggcaggatcataaacattggtcatggggaagaatgcttagtaagtgacttacttcctcttttggggaagctcgtttagggcaacataatttgccagttactataacttcctcatggtatttggtttctctccaagcctgcctgttggaagcatttacacggggaagcccattccccagtgcttagtagctgaagctctctgggaccttagcattcagagaaagtgtggtgccatggaaggactttgtgtaactctaggcaaatcacttcactttcagagcctcagttttctcaagtagtaaataggaataaaactgtattttctgatgcatgagattcatgttgccagccccctacctccctcaaaaaaattgtatcagaaaatttcctggctgcctggcataccgtacatcaaggtcctgatcaggctggaaagctgagaatggaaaataatacatgagactgccctgccccctagaggcggaatgtggcaaacacacaacaatgcaaagaccgatgcatcgcatccctttcaaaacaaagatgacaagccagagctacacggctgatcaggattattcctccaacattttagatgtaaatgtatcactatcatcacctaataggtaccatttcactaatgtttcactagtgcatttcgttggagcgatgtgatttttatacctttttaaaggagtgataggactgcatatccaggccctgtgatttcctgctggattccaggatacagcatactgcattcacctgaataaaaccaatattttccttcatataaccactttagaattattgtcattatatctgtgatgaaaagtacctaacttggctcttcccccacattttcttataaatctgagaggcatctctcacaactgtatatctgatatgccagccaattcataaacaacccatctcattgtgatggttgtgaaaattaaataagatgacgtaggtgaagcgctgagcacacagtatgtgtttactcagcgatagccattattattaataataactctgtaaagctctgtgctgtgggaggacaggaggagaaaccatgtggcagctcaccacatttcagagagagaggtcagtccagtgaacattgcatgccaggatgtgccatgccttgtgccatcacaggcagagaattctatgattagtatatagttcctggcttcaaggtgctcataattgggtggagaaggtggtggtggaaatagacgattgcagtgtgctatccagtgtgtcatgccagaggggagcacagggggccacaggtgctcaaaggagagacatcaccctggactgtcagggaaggcttactggaggaggtgatacctgagctgaggcttggaggatgagtttgagttagctaggtgaagaaggacagcatgtgggttggtgggaattgggggcaaaagggaggttaaggcagaggggccagcatgagcaaacacacagaggtatgggcccagcaggatatgtgtatggggaggttttttgtttgtttgttttgtttttttatgagttcagtacaaactagagcacaaacagagagactcgcaggggagtctggagggttggccggctcacatcttgaggacacttcactagcagcgtcaggagctttctgctgttttgtttttgtgttgtttttgtttttatttttttgagacggagttttgctctttcgcccaggctggagtgaagtggcgtgatctcagctcactgcagcctcttccccgccccaggttcaagcaattctcctgcctcagcctcccgagtagctgggattacaggcgtgtgccactatgcctggctaatttttgtatttttagtagagacagggttttgccatattggccaggctggtctcaaactcctgacctcaggtgagccacctgccctggcctcccaaagtactaggattacaggcatgagccaccatgcctggccaagtagcattttaaactgggggagaggtgcttattgtggtgtgggagaacatgtcaagagccacgttttggagagatccccctagagggcagtttggaagatagattggagggtatccagggaggaggctggtacagcagtctagatgagagatgatcaggcctgtgcttgggcagtgggagtagagataacctatgtggggagaaagatgatgatggaggggagcgcagcctgctctggaagctcagaggagtggcagcgttcatgaccagtagggttttaataataccagcatagaaatcaagaaatcacaagttggaaggactctgacaaatcatccaactgaagctattcattttacagatgaaaagactgaggcccagagagagaaaggacttgtataaggccagtcagggtgtgagcagaaaagagaacgctgattagaagagtcaccctagtatgaatgccagcattcagagcatcttttcttttcttttctttttttttttttttttttttttttttttttgagatggagtctctcgttctgtcacccaggctggagtgcaatggcgcgatctcggctcactgcaacctccgcctcctgggttcaagggattctcctgcctcagcctcccgagtagctgggattacaggcatgcaccaccacacccagctaattttgtatttttagtagagacagggtttctccatgttggtcaggctagtctcgaactcccgacctcaggtgatccgcccacctcggcctcccaaaatgttgggattacaggtgtgagccactgcgcccagtgcatcttttcttaaatgtgctgttctctttctccccctagctcaggcccagccttctttctgctgttttttgtcttacgtggcttcatttactgtaactgaggcagctcagaggcagtttctggcctgacagccaggtctctcatccctgtttttctgttttcatggaagagggtggacctgtgtctgtctttagtatatccccattaccttgggctgggcagctctaccccgggtgtctttgttttgaggctcgatgatatgatacataaagaacgagctttggagacagacagacctggatttgaatctatgttccaccccaacccgcaggatggcctcagctaggtcattttaccttttatgaattttagtttttctgtaaaatgggataacaatgcctattatgcctatttctcaagtttttttttttgtttgtttgcttgcttgcttgttttgagacagggtctctttctatcagccaggctggagaacagtggtgcgatcacagctcactgcagcctcgacatcctgggttcaagtgatcctcctacctcagcctcccaagttgcttggaccacagacatgcactaccatgaccggctaattttttttgtagagacagagtctccctctgttgcctgggctggtcttgaactcttaggctcaagcaatcctcccacttcggccccctaaagtgcagggattataagcgtgagccaccatgcctggcatatttctcaaggttagccaaggtaatttcgatggcattccctgatactgtaggtgctccgtaaatagataatttcgatggcattccctgatactgtaggtgctccgtaaatagtcatttttcttctctttcatgaaatctcccatggacaatgacttaacgaatcaaagctttgcttcccctgaaaactggtatatttcttccttcctaatgtgaggctgtcatagctcattgtatcttcctttttgcctcagccaccagttaatttgaagcatagctctagcatctttgttgatttcttttttggacttattttcgagttcaatttctattctgtgttcttggagtaagcaccctcaaatcctttgtgactcaagcaggtataaataactaatgggtgtaaatagttgaatgaaagtaaggctgaagaggctggactggcgatggtgggatttgaagaggaccagaggtggagcaggctggggcagccaagacagtatctgtgtggatggctgtgaggaaccaaggggttagttaggaggggccaacccgtcacccgcctctcttacctcctgttctcaaaagaagcatagatattggagaacaggacctcatgtcacccagaatcatcagcctgcccatttcatatttacagtgtggaagccagagttctaaagaaagagaagggcttgttttgacaaactaaatcaaagcaatgcacatgcacaattttcaaaaggcaaagtagtacataaggactcatgtagtaaaaaactgacgtcttcctatcccctgcttctcagccccagatgcaaccacttttcccatttagttcttctggcggtaacttcatatctctaaataacgtgcttgaatgggtatttcctatttatcaactttaaacattatcttgactttttcctaccatgacaaaataatttagcttatttacaacagctgactctttctcaacactccttcccacttttttttttttttttttttgagacagggtcttgctcagtggtccaggctggagtacaatggtgtgatcacagctcactatgacctcaaactcctgaactcaggcaatcttcctgcctcagtctcctgagtagttaggaccacaggtgcatgccactacacctggcaaagttttatttattttttttttttagagacggggtctcgctatgttgcccagttaggtctcgagctcctaggctcaagtgatcctcatccttcggtcttccagagtgctgggattgcaggggtgagccactgcgcccggcccctcccagattttgagagttttattattgtgtgggctcctctattagttacctttgtaactttattaagtactattttaaactgacttcttatttcatcagttttccacagcatctcttgaccacgtactttgtaagacatagttattagtgccatccttccctccatctctccttcccctcttccacctcccagtctctatgttctgtacttgtgtatctagcaatgtagattacatttgcattctattctgtaaaaataattatgttttcaatgctttatctagagagattgattataaaaattacctggcagtacactgtttatgtgattatgactatgtcactattagtcatcgcagggccaaatagtgtactgtaattatacctcattactcacagttacacaacctttgtactcccaggattgttttaaaacttcataccgaaatataatatgaatacagaaaagtgctcatatcagaagtgatatgaccatatcacaagtgatatagtcactttttacaaaccaaacacctaggtaaccagcattcagaacaaggtctgttttttattcaccctgaatagtactcaagcagccctttcagtttgaaggactaagtctcttctttttttttttttttttttttttgagatggagtctcgctctgtcgcctaggctggagtgcggtggcgtgatcttggctcactgcaacctctgcctcccgggttcaagcgattctcccatctcagcctctctagtagctgggactacaggtgcccaccactatgcccggctaatgtttgtattttcagtagagatggagttttgaactcctgacctcaggtgatccactcacctcagcctcccaaagtgctgggattataggcatgagccgccgtgcccggcctttttttttttttttttttagacagggcctcactctgttgcatagggtggagtgcagtggctcaacctccacctgctggattcaagtgattctcctgcctcagcctcccgaatagctgggattacaggtgtgcactgccacgcctggctaatttgtatttttagtagagatggggtttcaccatgttggccaggttagtctcgaacccctgacctcaagtgacctgcccaccttggcctcccaaagtgctgggattacaggcgtgagccaccatacctggccctctccttatgttatttctttgatcattcccttcccttaatttgctctgttttcttgtttgggaatgtctcttagttgggtgttgaacttcctgtaggctgttgatcctgtaggctgcttaccttttctctcatactttctattttatggtatgtgaataagttaatagaaagtctgactgagccaggcgtggtggctcatgcctgtaatcccagcactttgggaggctgaggcgggaggatcgcttgagcccagaagttcgagaccagcctgggcaatatgataacatgatgaaaccctgtctctacaaaaaaaaaaaaaaaaaagaaagaaagaaagaaaaagaaaaagaaaaaaaaagaaagtctgactgagtggtgagctgcctatgtatccaggcttgcttgtccactcactggcttcattttggcgagctggcagggagttggttgttataatccccaaaggccagaatgaatagcactttattttgggggcaccaacatgccactaggtgtcttgactcatcctagatagtttaattcctttagcaagcagccctctgatactttgcctacgggtgaatgccaggcggcctgtgttctaggtctgggggttggggtggcagggaaggaaggatgtcatatacttaccttccatttatccctgtgtccagtgccgtggttcctcctaccctctcttgcagctaccatctccaagtctggagtctctctgggcctctgctggcctgactgtctccctcctcagctgcaagcccctaagtggtgttcctggatcttcctcaactgtgaacaccctgctgtttgtttttttgcttccagaaatttgttgaaatctctcacccactgatctcaccctctcccatcctcctccctgttatgagttcatactttattttattccttcactttcattatggtggggtcctgggagagagaggagataaacatttatgcccttgaggtggaaactaaggcgaaagctactttaaaaaatggttgttttgctttttcaacccagactgaaactggaaactattagtaggccccccacatagccaagcctggatgacctcatttggggtcatccaagctgtgttgcttctggccccagcccttatcataagcattcctccattggcctccagagcacccctttcctcaacctctgctgcctagaccatggagtcaagcgagccctcagccgaggaaccggacacctgggttctgatcccagccctgcccctgcctccctctggacccctgggccagcccctccacctctctgggtgccctctctgtggcttgagaggctctccgtctgctgtaagctgggctttgccgggattggctgggtgcttggagggcagcccagcctctttgtccaggcggtgggagcaagtgggccagagatgggccccaagcactcgggggggcttggaggctgagctgaggcttctgcaacagcaggctgtgctagctgctcccccttccgcccactctttcccatcatggctgaacctctatctctctgcctccagcagagagaggagagaaggcagggctagagagctagttctgttttcctttgcttcttctctctctctgtcattgtagtacccagctgatctgtgctacaatacctgtgcctaaccgcaccttccttttttggtgttccccctttccgtccttgaatgattgtctcttctagaagcgctccttgagtgttcatggggtggggggctttgggctgcactgtgtggtggggagacaggagacagatgagggagaggggccaagcttgcaggctggaatgggagatgaagtgccacttggctctgggatgacagaaggaagcagcagctgtagcagttaaaagcattggttttggaatcagacaaacctagacttgaatctcggctctactacttattagctgtgtgagtctgggtaagtcacattgctcctccgtacctcagtgactgcatccatacaatgagaagaactactttgcacaacagttatgaagactgtgcaaagtagtaggtacaactgtggaccactgtaggtgcaactaaatagtaactttatggctgggcatggtggctcatgtctgtactcccagcactttgggaggccaaggcaggattgcttgaggccaggagtttgagaccagcctgggcaacatagcaagaccccatctctacaaaaaatgaaaaaattagctgggcgtggtggtgtatgcctgtagtcttagctactcgggagactgagagcagaagattacttgagcccagaagttcaaggatgtagtgagctatgatcatgccacggcactccagcctgggtgacagaatgagaccctgtctaaaaaaataaataaggccgggcgtggtgggtcacacttgtaatcctagcactttgggaggctgaggcaggtggatcacttgaggccaggagttcgagaccagcctggccaatatggtgatactccatctctactaaaaatacaaaaattagctggatgtggtggtgcacacctgtaatcccagctactcgggaggctggggcacgagaatcacttgaacctgggagacagaagttgcagtgagccgagattgcaccactgtactccagcctgggtgacagagtgagactctgtctcaaaaaataaaaaataagaaaaataaatagtaactttatgattatttggattattataaggcagaatatgctaaggcccaaataaagtctgcttattactttattatgattatataacatatagtatttgcttatgattgaaaggagcatgaggttagggaaggtattctctaaggaggcagcttttgacctcatcactccttggatcaagcctcccaggggctccctggcaactacagaatgaggttcacgctgtgctgcctggtattcaaggctctcttggttgtaatctctgcctttcttctcttcaaaatgtaaatgtgaagtgatacttttctctttacttcctgaaaaagacatttgaaaagtgatagacaaatatttcatttgaggtatatagcagtcttcctcatcattgtcatcatcatcaacatcatttttatcatcccagaacctgtacagtgagttgtgttaaacaaggactataggaacaataatcaccagcaaaaggatagccagcaactgaaaccatcatggccttcattttgtcctttaccgccatctttgccttcaggattgtttggctccattactaaaagtgattccagtatccaacaagctttctgatttgtcctatggttctatttcttctttttaaataatcttcatgagactttcttgcataacaccattacctcatccacctgttcgctatactttttgtcatttctaggtctgattcttggcttccttagaaaagagtcttcctctctacctgaatcatcttccttttttttttttttgagacagagtctcactctgttgcccaggctggagtgcagtggtgcaatctcggctcactgcaacctccacctcccggattcaaacaattctctgccttagcctcccaagtagctgggattacaggcaccgcgcccaccaccacgcccagctaatttttttgtatttttagtagagacggggtttcaccatcttggccaggctggtcttgaactcctaaccttgtgatccacccgcctcagcctcccaaaatgctgggattgcaggcgtgagccactgcgcctggctacctgaatcatctttcaaaaggttttcactttcacttttttttttttttagatggagtttcgctctttcacccaggccggagtcaagtggcacgatctgggctcactgcaacctctgccccccaggttcaagcgattctcctgcctcagcctcctgaatagctgggattataggcgcccaccatcatgcctggctaatttttgtatttgtagtagagatggggttttaccatgttggccaggctggtctccaacccctgacctcaggcaattcacccgccttggcctcccaaagagctgggattacagatgtgaaccaccacgcccggcctacttttactttttacattgtcatgatttaggtgtcacttgaacttgggaatcatctttacctccccctagtgcttttctccttcctcgctgtcacaagtaggtcttcacgccacttgtggtttagggaagtgcttgcatgctcctttgggtaaggctacagctccactcattcctcaagtcactctgtttccttcctaaccctacactcaagttgtactgaactatgtagagtttgctaagcatgtcaggcttctttatgcttccatgactttattctggctgttcctatggctaaatgccctttttttttttttttgacagagtctcactgtgtctcccaggctggagtgcaatggtgtgatcacggctcactgcagcctctacctcctgggctcaagtgatcctcccactccagcctcccaagtagctgggaccacaggcataggccaccacacctggctaattttttggttgtttgtagggacagggtctccctgtgttgtccaggcttgtctcaaactcttgggctgaggcagtcttcccatctcagcctcctgagtagctgggactataggcacacaccatcatgcccacctaatttttgtatttttgtagagacagagttttgctatgttgcccaggctggtctcgacctgggctcaagcaatcctctcactttaacctcccgagtagctgggactataggcacacactaaaatgcctggctaatttttatttcattgtagagacgggatctccctgtgatccccaggctggtctcaaactcctgggctcaagcagtcctcccgccttggcttcctaaagtgctgggattataggcatgagccgccgtgcctggccccaaatgcctttttacccttgtctacatggcagataaccagttaacttttttttttgacatagggttgtgctctgttgcccaggctagagtgcagtggcatgatcatagctcgctgaagcctcaaattcctgggctcaagtgatcctcctgcctcagcctccctagtagctgagggaggcctagaaacttatttctctctggtgccaccacgcctggctaactattcaaatttgaagaacatctaagtacctcacactgttcaaggcacttggaaacagtgagcaaaatagacaaaacctctgccctgtggagctgagattctagtgtatggatgtctgggatgggtgtggaaaagaaacaaataaacaagaagacacataatatgtcaagtagtggtaagtgctatggggaaaataaagctgcatgagcctggggattgcagaaggcccagtcagctccaccacagccagtgtttgcacaaccattattaagcagcattttctcatttaagcattttccaatgttatcacatattctttataaccataatcctcccaacaaccgtatcatattagtgctattattatctccattacattgatgaagaaactgaaacttagggtcataaatcgcatagctggaagaggcagagctgagacccaaatccaggcctgtctgacctaaagcctggactcataactactgtcattctacaaacctcaacacaattctctgaagtcagaattattatgcctattttatagttggggaaactaagttcagagaggagaatggattcatccatgggttgcacagcaaatgaatggatttgaacccagatctgtgaaggctagggccttctacaaaccctgaggcctaaggctctatagacttgcctgcctctacatttctagggcccaagcaagttaccagttgaagcccttggccctccacacttctcttccctcccatagttcatatggagccttgagatatgtggataccccagccaacacctccaagccctgtctatctccccttccccttaggccgctccttggtcctaacagatggacctgggtaataagaccatgcaattcctgaaagtaagcccaagaaatttaggcaggaaattctgaggtccttggtgcttgaagtgcagcctagaagggacagggccaaagatccttatgggtcctgatggcattacagaccttttgcctgatggagagtggcccctaaaatgtgggccccagtgtagggccttctgtttatcagtacaacccataagattgtgattcgtaataggctggcctccaagatcctcctcctttggcttcctgagctaggtcctgctttgcagggaagggagcagggggtgttctgtgggcctgggccttcagaggctgtggccggtgaagaatagagctttcccagcaagccctggtggacatgtgcactgattcttatgccccccgcctcacagtattttgttcccagtactctcaggctacttaaccaatttaatttcttagtagcgtttaaaaaattatactttcaatgcatttttaaattaggaaatttagaaaaactaggaaaagtagaggagaaaaacattacacataattacagcacccagaggcagccactctgagcatctggtgtatttgcccttgttctctgcatttttttcatgtagttgaaatgattttacacatacaatttttgttcttgatttttccatttgagcatttcccatgtcattgcatattcttcataaccatcatttttagtggcaactgatataccacgatggacttaaccatcctcttaatgtagggtgtagaagctgtgctcatttttttcactggtttaaatcatgctgcgataggcttccttgcacacacagcatcaaaggaacttacagcttttagggaattgaccttatatagggacaattgtattcagcttatttccctttctagatggtccctctagctgggtccaattcgtttatttagtcattcatttattcattaatttcgtcaccacatatttactccatacgcctggaagccagactctgagatctgggggtccaagcaggaatgagacagagcgcctgactaccaggagctcccagtcgctgggagagtcagccatggaaatagacaatttcagaacagtttgatcagggctgtgatggagtcaagaaaaggatactgtgggagaacagaggaggggctcctaacccagcctagggatgttaagatacgcttcctggaggaggtggtgcctaaatgggtcatggaggatgaataggagttggctggaataagaaagggagcttcctgttaaacacaatgagttggataaacttatttctctctgttgctttcccaaatctcattaaaatatgaaaaaaggagtaaaaaaggtagaaacacataaggtctgggatgctgaccagaagtaaactattctacttagagaatcccagcagtgctcaggattgagaggtactgaaggtacatcctcagaaggcaggatgaagtatggacctgagaatgggaatgttgaaagtcttttctgtccgggcacagtggttcatgactgtaattccccccccaactttgggaggctgaggtgggaggattgcttgagctcaggagtttgagaccagcctgggcaacatagtaaaaccctgtctcaaacaaacaaacaaacaaacaaaagattggctaggtgtggtggcatgtacctgtggttctagctactcaggaggctgaggtgggaggatcgcttgatgagcccaggaggtcaaggctgtgagcgatgctcacaccactgcctcctagtctgggcagcagagagagaccttgtcttaaaaaaaaaaagtcttgtctttttggtccttccccaaccccatccagacagtgagtcccccactcccagctgcatccctgcagatggaggttgcttctttggagaaactgaagttaagaggctttgacttgaagtcaccaagtacagtggaggatggggtgaaacaggcctgcaggcaaagggatctgcagcctaaaacagtggaaccccaacttccttccacttaaaacagtgggactccaacctccttcaactcccccacttctaggacaccaaagtcaggtacacagatgagatcaaaggattgttctctggggaaactgaaaggccccagaaaaaaaggcctccaaaagccgacatttggaagtcttctaacaaaagaacagcctttcagcccagtaatttgatagtgaagcccaccacctggcaagccccacctgcacacagagtttccaagcagcttggtagtgtcatgggaactaatctaggaacaccagccaagaacccttaagattaggtatattttattttaatgtaaactaaacctcagtacactgggccaggcatggtggcctatgcctgtaatcccagcattttgagggggctgaggtgggaggatcacttaagcccaggagtctgagaccagcctgggcaacatagcaagaccttgtctctaaactaaaaaaaaaaagagagagagagaaagaaagaaaagaaataaacctcagcatatgtttttaaaaaccccaagctcttggtagccagagataatcagatagtccaaggctatttgaggaaaaccatcaacttggaagactgattgaaaaagcaaacaaacaaacaaacataaaaaaggaacttggaaggtaatgaagggaggagaagaaacctgggaaattaaaaatagtgagagctaaaataaaaatttcagcagaaggattagaaaataaaaggtgaggaggtatcctaggaagcagaataacaagacaaagggacaacagaagagaaaagatgagaaaattggaggatcaattgaggaactccaacagccaacaataggagttccagaaatagagaatggagggaacagcaggaaggaaattctcaaagacataatacaagaacatttcctagaactgaaggagtgaaaactcctgctgagtacccagcaagataaatgataaaaagacccatgccaagatatgccgctgtgacatttcagaataccagggattaaagggaagatcctaaaagcttccagagaaaaaacatcatatgcaaagaatcaagaaaaggaattacgttggacttatcaacagcaacactggaagctaggatatgatggagcagtgttctcaatattctgagggaaaagaatttccaacctagaagtctatactcagttgaatggtcactcaggtatgagggtatataagatctaaaggttttaagtcctatgcctcctttctcaggaagccctggggaatgtgctccagcaaaatatgagcataaactctaaaaaaaaaaagaaaggaaaaaaaaagccacggaatctaggaaacaggaagttcaacgcaaaggagaggtgaaaggaattcctagatgatggaaaagagagaggttcttttttcttttttttgagacggagtctcgctgtgtcgcccggtctggagtgcagtggcgcgatcttagctcactgcaacctccgcctcccaggttcaagctattcttcagcttcagcctcccgagtagctgggattacaggtgttcgccactgcgtccggctaatttttgtatttttagtacagacagggtttcaccatgttggccaggctgatctcaaatccctgacctcagttgatctgcccacctcggcctcccaaaatgttgggattacaggcatgagccaccacgcctggcctgagagagaggttgttagggcaacatctgggcaggcctagagagcagccagcctagattgcagcaggaaggtgggtgtttttaagggaaacaaagagtccgatggattacctgatatgtcaaagcatattgagaggagaattgcgcttctgacagtttggggagaattgatcatttgtatgaagagaactaagccgacaaaaaaataatggacagtaatcaggctgggcacggtggctcatgcctgtaatcccagcactttgggaggctgaggtaggtgaatctcttgagcccaggagtttgagaccagtctgggcaacatggcgaaaccccatctctacaaaaaatacaaaaattcaccaggtgtggtggtgcatgcctgtagtcccatctactcaggaggctgaggtgggaggatcacttgagcccaggaagttgaggctgcagtgagctgtgattgtgttactgcagcctgggtaataggatgaggacctgtctcaaaaaagaaaaaatatagacagtaaacaatagcagggaaaataaaaagttgtatgggaaaggaaatgtaatcatagtatgtcatatgatttatccattattagtatccatgcagtcataataacgtagaccaccagcctaggcaacatgatgaaaccccatctctacaaaaaatgtaaaaattagccaggcatgatggtacatgcctgtaataccagctactcaggaggctgaggtgggagatactgcttgaccccaggaggcagaggttgcagtgagctgagattgtgccaccgcactccatcctgggtgacagagcgagaccttatctcaaaaaaaaaaaaatgtagaccaccaatgttgatttaacccaaactttgtgatataactctgatggtagaatgagaggagggcacagttgttcagttgcaggacacttggagtgaatggaagtggtcactgcacagtcgtgtgtaaaaacagcatttaggctgggtacggtggctcacagcagtaatcccagcactttgggaggctgaagtgggcagatcacttgaggtcaggagttcgagaccagcctggccaacatggtgaagccctgtctttacaaaacaatatgaaaattagctgggcatggtggcacatgcctgtaatcccaactactcaggaggctgaggcaagagaatcgcttgaacccgggaggcagaggtcgcagtgagccaagatcatgccattgcactccagcctgggcgacagagtgaggctccgtctcaaacaaacaaaaaaaaagttcctttagcagacagtgtgagaaaggagctgacatttgcggttaggtgtaaggtgatattcaggagagaaaatgaaaggctgattcggggccggttctcagcttttggagagacccgcatgatttctgggccagggtacctgtctctttttccttaggacgctcctgggaggagccccgttcatagttgcccttcaagtttcattcttcaaaaaatctacttctgggccaggcgcggtggctcacgcctgtaatcccagcactttgggaggctgaggcaggtggattgcctgaggtcgggagttcgagaccagcctgaccaacatggtgaaaccccatctctactaaaaatacagaattagccgggcatgatggcaggtgcctgtaatcccagctactcaggaggctgaggcaggagaatcgcttgaacccaggaggcggaggttgcagtgagccaagatcgcgccactgcactccagcctggtgacagagtgagactctgtctcaaaaaaaaaaaaaaatctacttctgttgatgttcagtctcctttctgtaggagacataatcttttaggcatgttattcagattctggcttgaggaccagtctgtgatcattcaagttactccgcattatctcatttctgatgcattttgtatttatttaattagttttgctttcagggacaagcttcttgatctaatttcaggttcctgggaagaggcaccatattgttccccagttactgcttatgggtggcttggagcatggcaggaaatctagtcaagaggcaagggcagaaactccaacacagcagctccaaggcctccattcttttcagtcattctgctctgtcttccccataagtccccaaaaggttcaggaactttcgatattctgccatttattctctcatcttccagattgcttcttcttttttttttttttttttttttttgagacggagtctcactctgttgcccaggctggagtgcagtggtgcaatctcggctcactgcaagctctgcgttctgggttcatgccattctcctgcctcagcctcccgagtagctgggaccacaggcacccaccaccatgcccggctaattttttgtatttttagtagagatggggtttcaccgagttagccatgatggtttcgatctcctgaccttgtgatctgcccgcctcggcctcccaaagtgctgggattacaggcgtgagccatggcgcccggccaaattcttgtacgtggaagaagcaacattaaaatctctggtcagattacatgcctgtttttgattcagaaaatatggttactatcctcaaagctccaacaagttactatttattggccatcactgctgaggatgggagttggcatatccaaatctcttgagaatcctggggcctaagtggcctttcattaagacaaggctggccaggtgcagtggctcatgcctgtaatcccagcaatttgggaggctgaggcaggtggatcacttgaagtcaggagttcgagaccagcctggccaacatggcgaaaccctgtctctattaaaaacacaaaaattagccaggcacagtggtgggcacctgtaatcccagctactcaggaggctgaggcaggagaatcgcttgaacctgggaggcggaggttgcagtgaaccaagatagtgccattgcactccagcctgggcgacagagcaagactctgtctctaaataaacaaacaaacaaataaataaataaataaataaaaggctgtggggagtagcaggagaaatcggtctcctttactgacatggattgatgaagagggatctagtccttgggtctattgcttctccttgtagacagcagaatctagttgataaaagagataaactttggggttctgaagaaatagaatattttaaggcctaaagattgcttggaactcaactaacacagccctatcactttacaggtgaagaaccaaggtccagagggaaatgacttgtccgagttcacactgccaattagggaatgagccataaaaggacctagcattctttctaccagtctatactgcctcccaaaagaatggtggcccagcttcatgaacattggacagtgcatgagcctctgaggaggtgtaggatagcactgatgattgttctatacataatgaataatatgctaaatgcataaagggtgatggaccctggggtgagctgcacccccacattgagagtcatatgatgctgtgtaccctcaagctagtaagaatcagtccatagcgagaattggcgaattccccgctgcatcatgacttggagctcttttgctcccctttgctgccatcttgaggactgtcacatatcacatagaaatacttttggagcagagatatatttctcataatctctcaggtgaaagagcactggagaggaaaggtctgttggtgcctctctggcttgatattgaggaatgaagataagggaactcaccgtcatagtgcgtacgtgcccggcactgagcttctggtacagtggagcgtggtggtaggaacatgagctttggggttcactctgagcttctctgcttgtgtgaccttgggcaagtcattttgacctttgtgagtctcagtttcatcatcttgaaattggatgaataacccccactttgcaggatcaaaggagataatgtacaaaaagaggctaacactatgcctggtacatagtaggtactcatagtttgttcacagtggtggtgggggtgattagatgtgttgcttaaaccttaggtagattgggacaagtggccagtccacgagctccttgagaggttgtattcccagggcagggcctggtagacagcagactgaatacatgtgtgctgggtttgggggtaggtgggtggtgaagagatcggtctgcctagagcagagggttagtgttagggagagaggctgagaggcttggcctcagttctgtaggcatctggggagtcattgaagtcaggcccctcaggcctggtacctgagaataattgggccaggcctcagaagcaatcttgttgctgcagaaggagatggaacattttaataaatgtgataaggtgcgctgtggccctggtcctctgttccttcagggggctgagaaggctaaggattggtgctactggcatctgctgagcatgtaccatgtgccaggcactgtgctaggctgagcctcacagccacaccccataaagggagtgactctcaccgcagcccacccccaaagccccattttacaaggcaaagccctgacactcaacatagtgaaataccttccctaggattccatggcttgtgaatagtggaaccgggagtgctgtggttgcagcaccctgatgcttgcctgccccacctcgccagcggggcctcctttcattctttcaacaaatgctcccttctgaggcccacctgctcctctccctgtgtgtatctctgtcatttagcgcttagcatagatggacactcccctcactaaagccacgtcttggctctctcagctgaggacagagcctgtgctgtgttcatctctgtctccttcgcagcatgagtgagggtgggaggcctgaggtgaagatggaggaagatgacaagggggatgtccgtgtcccacacgctcccactttcaaattccatggtcctcctctgccccttccctgcacgcagtgaacaccagccccactgtcctgatcctccctcccgtacacacacacacacgtgcgcgcgcacatacacacacgtgtacacacgtgtgtgcactcacgtatacactctcacactcttcttgggaaggcgtggtgggagaggaagggtgtggttcagatttcactcattgcccggttccctcagtgatgtccccaactccattctcttctttcgcccttcttttgcctctaaagaggcctcacaatgaaaacggcagaccagtgtagtagaaaggagcccagcggctgactcatatatctcctcagcctcgttctcttcatctggaaaataagcaggttggaccaggcagttggcaaagccccttccatggtgttaataatacctggcatttgcgtaccgggttccaaagggctgaattatcccaacagcccagtgaggatcggcctcgtgtcacaaacggggagactgaggctcagactcagagaggtgaagtgacttgcccaggtcatggggctggtaagtggcagagccaatatctgaacctaggtcttcctgtgtttcaagcttgggctttgcccctgcccacggctgctggctgcctcgacgaaagccacgctcctcactgtgatccactaggccccacatgtttggttcctggtgcctctttgacctcacttctgaccactcttcccccttgctcactgcaccccagcaccaccgtcttcctctccatccctccaactggcgaggcactctactgtctctcggccttgcacttgctattctcttctctccgcatgaaataacccttcccctcatttttgtgatgtgcattaggcctcaaggccccccaaagccactctacctagggcagagggagaagagagcgtatactgaccgttttggttttttttctctgtttccctttcagatctgatggtgagaattccagaacagtcaggtcagtacctcctttctttagtactagttgggagatggggcagggcctggggtgggggcctctggtttgtaactgcaggatccatgggcaaggggaggggccaactcaagggcgtcttccctgttggtattaggggtggctatggagtggggtgagagggcagttgggggatgtggcagctgtggggagggggttcaagactgttccttagtctttctgacactagttgacttgggagcttggctgaacaccataggggctcataggagctgcccagatatgaaagctgagaggtcagctctggacaaggaccttttccaccttctcctcccagggtaagagggcatgatcgatgctgagcttccctggtctagcgttcactttccaccctgaatctgtgccagccctgagtagtgggatttgaatggactctggatgtaacacattctagacattagaactatacattatggcgacaaggaaaatttttttgtgtgtgcttggtaaaaaaagtttacaagcttcagtacgttttattttattttattttattttatttttgttgttgttattgttgttactgacccattggtagacatagtaagttttaaagatgtgctcaatctgccagttggggaggcaggagtaaaacttgggtaaaggtaaagacaagggacctttgtgcatttcccaggccttaccccatcagaagcttcatgaaggcagaggtgtcaagtatagggattatataggaatgatgggggtgctcaggataggacccactcagccttaacatccaggctgggggctatgggataggccactgagctgagctgagcccaggcagcagaggcacagatgggtacagtctttcccagccacggctgccagtagcataattggcacctttgtgaagaatagaaaaagatgtccctttcaagggcaccccctctgagtggctccattgagcatagcacgggttggatatcagcccctgttcatatccttttggctgtgaccctttgtgaaaggcacagcttgcctgactgtatgcaggagccctggtcctgtcattcaggcagtggatatgggctggggacagaggatgccagcatacagacaaaagtgtctaatgagacacactctgttctagcaccccagacaggggatctggggtaaacacacggatacccagagccaagaatggggctgtgggataaacacatgctgaggccagctttaatgcaatcagtcccagtgtccaggaaaggggtttgtgacaagacataattagtcctagcatgcagccaaggagcatgtcatgggcacagcttgtcctagcacttaggaaggcacctgtctagcaaagggaatagatctcagtgtcccaccgtgggtttggagagaggccacccgagcacggggctcctgcaagcatccccggtgatgtgcctgctacttgttgaagaagaagattgaaaacatctctagttctcagctcttcccagcaaggaagttcctgggacctagagctcaggacatttaataacgagcataatcataagtcatgtgatgatatacatttgggcctttacaacttacagaagttgtcagggactttcttttgtctgatcctcccagtgacactgtaggtagaacctgagctggccttatcatcattgttttacagctgaggaaactgaggctcacagtggttatgggttttgcctgcagccaggcagctaatatgtggattcagctaatatatggatcctgagccaggattcaaacccaagtctgcctggcgccaacccagagtgctacccataccatcaccacgggagctctcgacagcctggcagataataatcatcatcctcatcctcatcctaatattagcaattatagcaatcaccatttgttcctcacatactaacaacttggaatatgatcttatttaatgctcacaacagccctaataggcatggattacaatccctgatttacagatgaggagaaggaggttctgagagagtcagtgccttgggctgtctgattccaaagccagcatttaatttattcagacacgcttcctgacatccatcctgggcccagagtcaaggaggctgtaggggcctagaggagtcagcatctgggaagcgagggtcaaactcaggctatgggaaggggctaaagcatggcgtgtatggggcaatatcttgacaacatggtgggaaggcaacttgaacttgcaaccagggctgggtagggacctacttgtaaatttttgaattcgctccagttagggtgaaggagagcttgctggagcaggcagcgtctgagcagggctgtcggggactgccgtgcagatttgcataaggagggtgtccccggaggtgggatcagcttgtggagggaagcgaggggggtgggtttagagacagggagccatccgtggggctaaaatagaagatctaggcaggaaaagagcagtaaggtcagaacgcgggtcaggactgggtcacagcgaccttctgtcatcagtggggagctggggaagttggaggagagaggcgaggctctgtggcctaggaagggcagaaacactggatccatgcacaggcctccatttggggggtgggttgctctctagttgtgtgactggacaatctgtttgtctcttggagccccagtttcctcatctaataaacttcatgtgtgtgtggagggggaagggctagggaggtggaagaaacaccgaggagaggcgctaggcctgggcttttatgggaactgaatagcaaggagagagcagagtcggtagattgcaagccacccttggcatgacccaggcctgagggcttctaaagtatggggtgccagaggaagtgtggcgtctaattagagctgaacagttggtgatgggggtggggggtaggcatgggcagagaaaggtgcctggacttcttgtgggtccctgagaagtgtcacagatctgacctaaagataccttaagccaaggtccagagagggattggccatcgctcgaggtcacaaagctagctagcagcagagcctgcttcctagctgtgcactctttgcagaatcacttaacttctctggttcttagtttctcatgggtaaaatggaaacaatagtcttgacttctctgggttgatgagagaacttaaagtaaagcaatgcttggtgtgaaatagtggtgcaacaaactgtagtgtcctctgctttcccctaacccaatccattgtcatatgctatatagtcaggctggaagaatgtgaacaagtgtagaacttgaaaacagagagggcaggacgggcctgatgaggccctcaccagaagatgagggggcccaggcctagaggcactgctgcagtgagggtcagcctgaacttgttggccctggggaccaggctggggttgctaggcacgcaaggatgaaagcaggaggaggtggcctgttgctagggaaggagggagggggtgggggagccgctgacacccgcggagacagggacgtccctatggcaacgggagccactgcagttggaggagaagtgggaggaggagcctcccactgtgggcctcagtgctccaatctgtcctacaggagtttggattagataatctcttgttttcacctcttggcaatctgggatggccaagacctcatgaaccgtctgtggctcccccatccacatgtccaagacactacccatccccagagccatccagctgcatcacctcccatgatgcctcccatttggctcagcccggttgcccaccctgccctgttcctaccacttcctttgcctggaaccttgccacttactgcttcacagtctggggttgctgcagacacagatgagccagctcgggccagcccaaatgggagcgtgatgatggtgtagacagccagtttgtgaggacagaagtctagaggagtcagagctggattttgacagtgggagagaggaggaggtaactttccaggaagctaaagaagggcaagaaggggtaagaggtttctcttctcctccccttcctctctgtgttctgccgccgcctggcccagccccaggaagtgggtgacccctaagctggctgagtgcctggttggcaccgaaataaacttgccttctctctcttcccctccccttgcctctgtcccctctgtcctggctttaattagcagccctggggatgagtcacttggcagctggggagggaggctgcacagagctcagtgaagcttcgactcctgccctgagccttacgggcagcacctctgtgtttatgcatgtgggtgtgcactgctgcatggcagcgtggctgtgaagagcaaagtgcaacactgcatgctggcgcgtggccctgcatgtcagggggtctgcagagaaccatatctggttgctgctgcgtttgttgctgtgtgccactgaatgtcagtgtgtgtgagcgtgtggctggagcgtgtggctgtggttgcaagtgtcagggaaccagggagcttctgggtgaacaaacacaaacgctggacaattgcattcacccctctctacctaagtgttctttatgcgattttgcttacacaaaccctgcacttacattcccaattttcacttgtcttagtctgggtacactttgttgtgaggaacggaagcccactcaagctagctcaagaataaagggctaatgaggggactattgtgaggctacatttcacagaatctaagaacagttaatgaaaaacagccaggcctcacaccaactggaagtgggaccaggaagtcgaggaccaaggttgctgtctcgctgtctgcatctcctgggcccatgtctcatctttctccatctctcatggcttgcctggtccctgtcatctctttttctttctttctttctttttctttttcttttttttttttttttttgagccggatacttgctctgtcgcccaggctggagtgcaatgccatgatcttggctcactgcaacctccacctcctgggttcaagcgattctcctgcctcagcctcccaagtagctgggactacaggcgtgtgccaccacacccagctaatttttgtatttttagtagagatggggtttcaccattttggccaggatggtctcgatctcttgacctcgtgatcccccctcctcggcctcccaaagtgctgggattataggtgtgagccaccgcgcccagcctatcatctctttttcatggacttctctctctggaccagcttcctctgcttgcccatggcctgacatggccaccaacctggaagctatgtgaccttttccagcttcaggatctgcccctcctgccattggactgcagtgatcctccagcctgtggtaacacaaggcagcaaggggccgtgtgagataattgattccctcagaattggatgagaggagagagagaaaacacttggtacttcttgtttcttctgcagtaagcacagtttttatgtgtacccaagtgaggtcagagctggtcggctcagaggcaaacacttgtaagattgtttttggttcctattttatagcaagatgacctttgctcactgtgctttcaagttccatatccttgcatcaaaacatgctgttttgtctaaaagtgccctcttattttatgccgaaaaagcttttaaatgtacagtgaatattaccattgctaccagcttgtggtaatttttcataacctcagaacaactggtataaagctactgatggtacagctgctacccagctcttggtggcctcaggaattttgatattttatgagttcagtgactgaatttatagttacctccagtatataattacaagtacacattatcaatgttatcagcttgatgctggagcttacttttccactaatacaaaccctgcaggttttacattaattacagagggaactaatgaccccttagacaagttttcacctatgaataaagagttaggaatcagctgtgccagtaatgactgttctccagacacaggagcgatgtccacagctctggccttggccctgacctcgcatcctctggccgagactaggggcttcccatcacctcctcagaggcctcctgactctggcctggcacacagcaggtgctgttatttttaataaaattgatagttttatgattgctattaaagccatcttccatatctaaatggtaaacctaagtgagagagattatcccaggttctgggcagtctccttcaactcctccccctgcccttttctcactgttccaaatagtaataattgctttgagtcagaaaatgtctgctaaatatcaggtactattacagagcactggagacacattatctttaatctttgtggccaccctgccaagtaggggtgacttacaggtggggaaactgaaacctagagaggtaaaatgacttgccccaaattgtccatccacacatccattcatttattccttcattcaaggatttattgagtgcctacaatgtgccagatgctgctaaatgtggctgatagggtggtgagtaacagccctgctgtgatgaagcccactgtctggtcaggaaatagacaaggagacagacaattacagacaattataggggaagtgcagggtgctgtgggagcaccacggaaatatacccaacccagcctgagggccagggaggcttctccaagctgacatctaagtggaagcttggagcatgagtagaagttagccaggggaggggttgggtggggcaaagtgaagtgaagagtgttgcaggccagaactgcgagaagagtgtttggcacccacgtttgtgaagaactaaaggagtatctgcagtgagatggcactgtcatgagaaacggtctcatctggaaagggagcagaaggtttatcgggaggctggaactgtggccctggttgcttaagtccagagctgaggagctgcaggacccagtaacagtttccatgtgacaattgtgggcctgggagcctcctgggtcggcctggccaacagcaggctgggattctagtggccacagtgccctctagtgtccactggcccaccttgcagcctccacctctgtccattgtccccccaccatgtgtgaccaggtgcccggtgctgagtgctggggacactgggatgaacaagacacagctctcacagagctcccgacagagaaggggcagcaggcatctgaacacagtgttgagagaagccggctgagaaaagagcagggcggaaggacacaagggaggtgacccaacctgcttgggtggggtcaaggcaggttcccagagggcacaacatctagctgacttttgaagaacaagggggagccagccaggtggggagatgacagtgggggcacagcgggacaacagaggtactattacagagcatttgacacacattctctttaataaggcttggagcagcagagtgtagctgagagagttgcaggtgcttctgtctgggtggggtgcaggttgaaggtggggggaaggctgagactagctggaggtatggggtaggggctagctcacagaaggttctaggatgcctgccaccagctcatcatgggcacttagtgaatggaatcatataagaagcttccctaccctttgggatcacagacccatccgaggatctgatcaaagctagagatgttctccccagaaattaatgcttttcatacaactttaggggcttcaaagatactccccaccccacatgcctgtcccaaaccacaggcttccaaattgctcttcctatagatacggaaaccccgacagaggcctccaaggctctgcatgctgggcccccacctccatctccagtctcacctttctcccctgtgctcttcccaccccgccacgtcagtctcttcgtgcttgctggaaataccacctcaggtcctttgtccaggttgtttcctctgcctggaatgctctcctcctgccatctctactttttgctcagttgaattgcattagttggtgaatgtctgtctcttctcacttggatataagctccatgagagcaggacattgtctacctgtagtcactgctgtatccagcaccggggacagtgcctgggccacagtatctgtcgaataaatgcatgaaggccctgccagtgtcccgtggctgggtcaggctcctcacccttcattccttcctcccttcagcctctggtgggtcatcatctgagtctgttcagcatgctcagctgtaactgaattccaaaagtggtcccaggttcagggatattttcttagaaatcttcctcactatccctgaaacaaacaggcttcccatgggtctcctctgcctctctgggagaagggacagactctctcaggttcaggctgagactatttaccatgtgcacactttgtctacctaccaaatccctacaagaactgtgaggtaggaatttccactcctcttccatagatgagcaaactgagcttcagagggcttacccagctaaaaagtgatagggcaaggacttgtacccagctttaccaggcaccaaagtgtaggttctttgtctcaccagagagggaaagggccttacccaaagtcacacagcatcatcccttaaagctaccactacactttctttctttctttttcttttgtacagggtcttgctctgtcacccaggctggagtgcagcggcatgatctcagctcactgcaacctccgcctctggggcttaagcgatcctcccacctcagcctcccaagtagctgggactacaggtgtgcaccaccatgcctggctaatttttgtatttttagtaaagacagggttttgccatgttgcccaggctggtatcaaactcctgagctcaggtgatccaccgtcccccacccaccccactgctcccagcctcccaaagtgctgggattacaggcgtgagccactgcacccggcccagcactacacttaatgtctctcggctcctgccaggtcaagagggttcagctcttagggcaataactacaaatgggcacaaggtgaagctgctgcaggagctaggagagttcctcaaggagagttaaaaaaaaaaaaaaggcagatgctaaggccagagccttgaggaccagggctttgaggggtgggcagagggagagaaggtcactaaggacccacagatgccaaccttgtggtgttccggagggcctctctctctcagtagctttggctttcttgagaggaaccagctgccccagcagggaggcaggaaggctggcctgttgcctgtcagcttctatttcttctagatcactggccccctggcccctcccagggccgccttctgctcagaacagccaggggcctgggctctgggaccgtgaaaggacaggagcactttgagctggacctgtggtattctcaggagccctacatccttcaaagccaaaaaactctctcctttctccagtcccgcccatgtggaggacagagatgttgctgtaataggcaggcagggagccagggcacctggagtctactctgacctgctgcatgaactttagtaagacccttttcctctccaggcctcaatttgcccatccataaagtcaggctgggcagtttacttggaagaacagcctcttggcatttcttttgattttccctcttctcttcaggaagcatttctctcagccagtctagaaaacaacatagaagagtgagagcttattgcagtgagaaagaatattggccggggccccatcttgataccccaacatgggtgatttgaattgcacttaatatgcagagtcccagaacaactcctaaacatagtctctttaactgtgctgaaaataagggtatttgtgaaaagcttctatggaaaggtttctgtactcacaaggtagcaatatggctgaaggggcagattccaggtttgggaatagccaaaccgggtcttgatcttggggttctgccacttactagcagtattacttcacctctctccatctcaattttctgttcaggagaatagagccagcgatacaaacttgatggggtgcgtggggagattctagcagaggtgcactgagggagcccagcctggggtttggcccagaggagggactgtgagctctccaggccgcttcctcggaggaggagttcccagccctcctggaggagtaggggaaggagcaaagtttccagttgcaatctggcccgcagcccagctggcctggccccgccttcttggttcctccttctagggaagggctggggaggagggggtggtgacacggtggagacaccggctaggccagggggcctgcccttgggacaggtccagacccatggagccccccgggaggagcagcaggtaggaacctgggccccgcagcctggccccctcccttcctgcccaggcctggacccagtccctgggctactgattcagcagcctcctggcttcctggttcctggctcccttcttggactctgagaggcctttggcctgggggagggagccagttcaagtgggagatcccatgggcatccaggtgcccagctctggaaggaccctggaaccctgagcagcacagcctgtggcctgtgaggggtgagcttggctcctaccctgctctactagccttgtgtgcgaggcactgcagggctccaggctcgtggcctctgagattctaacaccaacattccagcagcctaagagtctctgagtctcagattcaaaagagataatgagtcaaggacttgggctggagactggcacctgagaagcagttgccctgatgatgattaatccagagccttcgataagaagagtctcagattcaaagattccctgtaaggttctgagatttggacatcctcaaattcgcagctggcctggcccgcagccatgtctcctggcttttacatgggcttttgaatggccaggccctgaccacagtctgcctctgtgggcttgtgggggacaggggctggctgacctggaaggggtcggctccactcccagcttgctctggctccagctgactggcatacctctggcatctgcgctgcactgggtagggcagggaccaggccctcagcctccctgccctgctgtacctcctcctccccttggccattctccggactttaatcgcaggaggcaggaggtggaggggtctttggaccctgcactaggggtggtgggggcacagcatcaggggtggagtgtgggccccgccttggggtggggggtaaagcactggccttcaaagcaaaagactcctacctggaaccaccccatcctctgcctcacccactcagccctgagtcccatcctgtcaccaagaccactgagaccttgtcagcctcctccgccctcaccctcctctgctctggcgctctctgcctctctctggcttctctctgtgtcttctgtctcgccctttctctgtcttcctctttctctgtctttctccttttctgtctctttcggtttctctctatctctctccctctcttccttcagtgttccccttacccacccacctgggttctcccccttctttgggcccagagcttctccttcctccatcccttcctcccttcctgtgagggatcttctctaaggggagcccccatgcatctttcccccttctctttcatccccccttcccctcccgtcctccctacccctgtggcgtctggtgtgaggagggctcccttcccccttccctactgtggtgtcccagcgtctctgtggctgaggtccccacggagtcacctggaacacaggaggcccagcccggctctttcgtctctactgccccctgttgtcgttgtgttctgtatgtggttcgagtgccgtcctctctttcttgactttgtggtttttttctttttttcttccttccttccttccttccttccttcctccctccctccctccctccctccttccttccttcctctctctccatcttcctccctctctcccttcctcttttcctttctcccttatcttccttcctttcctccctccctgcctcccacgcctcctcttccatttcccatcctccattcctcccagccttcccttttcccctcccgcactcactctcaccttcttgcccccatcgcccaccctgccacttccctccctccctgtctctctctctgtctctctctgtctcttgctgtctctcaggtccacagcgtctcatactctacaccagtattgctgtcctactcaggtccttgactccatgaagcttaccccctcaggcaggctggcagagagcaggtaagagctagacccatccctcccccaattcctcctccttccagacaaatatacagtgtcattgccagcccctcccacctccctgagcccctgctgtgcctgtggaatgggtgtccgagtgtatgaggagagtgcctggaagatcaggtcagcagaccaaagaggacatttgggatctatctaatttgtccttccttaaaaaaatccttccctagagacctgccccaaaaggcctgagtggttggtcctagactatgtgataatccagcttttttaaaggatgaataggagtttgccagttggatagactgaggaagggcagttaggcagagggaacaatctgcccatatctttgcagaatgttatttcttttttttttttctgagatggagtcttgctctgtcgcccagactagagtgctgtggtgcgatctcggctcactgcagcctctgcctcctgggttcaagcaattctcctgcttcagcctcccgagtagctgggataacaggcatgcgccactacacctggctgatttttgtatttttcttttagtagagacggggtttcaccatgttggccaggctggtctcgaactcctgacctcgtgatccgcccgccttggcctcccaaagtgttgggattacaggtgtgagccaccacacccggctggaaaacattatttctaagttaattagaaaacctattttatgttttctaattacagctcaataaaaggaaatattaacagcagcagcaaaaaggctaggccctcctccctatttgaaagtttaaaaatacttgtgttaaagaggaaataagagtggaatttatggactatttagaataaatgtcagtgagaatactacaacttaaaacctataaaatatgggcacagggattcccagaggaaaatttataatcttaattgcttttattaaagaacaagatggtttaaattaaatggactaattattccactcaagaagctagaaaaaaacaaccaaaacaaagcagaataattactacaaataaaaccagaaattaatgaaatggaaaacaaaagatttgataaagtattaataagtaagtaaatatgacttttggaaagaccagctctacctagtttggtagacattctttggcagatatgactaagaaaaaggctaaataaataaatacattaagaaataaggaaggggatttaaccatagattctaaggagatgaaaaaaaagttattataagaaaatattggggccaggcgcagtggctcacgcctgtaatcccagcactttgggaggctgaagcaggcagatcacgaggtcaggagatcgagaccatcctggctaacacagtgaaaccccgtctctactaaaaatacaaaaaattagtcaggcatggtggcgggtgcctgtagtcccagctactcgagaggctgaggcaggagaagggcttgaacccgggaggcggagcttgcagtgagccgagattgcaccactgcactccagcctgggcgacagagtgagactccgtctcaaaaaaaaaaaaaaaaaaaaaaaaagaaaaagaaaagaaaagaaaaaaagaaaatattggttggacacagtggctcatgcctgtaatcccaggactttgggaggccaaggtgggtggatcacctgaggtcaggagttcgagaccagcctggccaacatggcaaaaccccgtctctactaaaaatacagaaattagccgggcgtggtggtgtgtgcctgtaatcccagctactagggaggctgaagcaggagaatcacttgaacctgggaggcagaggttgcagtgagccaagatcgtaccactgcactccagcctgggtaacagagcaagactccgtctcaaaataaaataaaataaacattgtatatacttttttaccagtaaatgtgaaaatatagatgaattgggtggttttctaggaaaatgtaaattaccaaagtgacttaaggtgggacaggaaacctgaataaaatggaaaagtagggaagaaacttaaaagatggtcaaagtggccgggcgtggtagctcacacctgtaatcccaccactttgggaggccgaggcgggtggatcacgaggtcaggcattcaagaccaccctggccaacatagtgaaaccccgtctctactaaaaataaaaaataaaaaataattagccaggcgtggtggcaggcgcctgtaatcccacctactcgggaggctgaggcaggagaatcgcttgaacctgggaggcggaggttgcagtgagccgagattgcgcccctgcactccagccagggcaacggtgtgagactccatctcaaaaaaaaaaagaaaagacggtcaaagttttctccccagaaatggtaccaggtccagttggtattctggaagttctggtatgatggaaattctagcaaatcttgaaagatcagataataggaaaagatagatagcttcccagttcatcccataaggctagtataactagacaggtttaaacaaaataaaaaaaaaacaacaactatagcctaatgccacatattaatagagcaacaactattttcaataaaagattatcaaatggaatccatcagtgtattaaaagaagaatatattgtgacaaatgaaagtttgccccaagagtgcagggattgttcaacattaggaaatgttattgtaatttattgtattaagatattaaagagaaaatatcatataatcatctccataaatgctgaaaagtgatctgattaaattatacatctattctgctgtattggggtagtttgttacacagtaatagatgactaaatagtaagctaggaatcatgaaaacttccttaacttggtaaagaatttttatcagaaaccaaagagaatcatcaaatgtaacagtgaggccctagatacatttccattgaattcaggaacaaaataaggatggctgctatcactgttattaaccaatatttttctggaagttttaaccagtgggattaacaaaagaaatacatggtataaatgttagaaagacaaagttagaattagcattatttgaggatggtatgattgtctacttagataattgaagagaataaaatgaaaaattagtagaactaagaagaaaagtcagtgcagtgagtagacacagataaatatacacgcaaaccattaacttctctgagtaccagcaataactaattagaacacataatagaaaagatcccattcacaatagaaaaaataattctataaaaccactatgaatttacaagaaatgtgaaatacttctctatagaaaactataaaatttaatcaacggctgtaagaagacttgagtaaaacaaagttatatcttgttcttggatgagaagagtcactgtggtaaaaatgacattttgttcctaatttggccaaaacattcattgcattccttattaaaatttcagtgatattttctttgggatttgagtgattggagtttaaagttcattcagaagagtaaatgttcatgaatcactaagaaaattttgaaaaagaatgcaggtggctgggcgtggtggctcacgcctgtaatcccagcactttgggaggccgaggtgggctgatcacgaggtcaggagatcgagactatcctggctaacacggtgaaaccccatctctactaaaaatacaaaaaaaaaaaaaaattgccaggcgtggtggcgggtgcctgtagtcccagctactcaggaggctgaggcgggagaatggtgtgaacctgggaggcagagtttgcagtgagccaagatctcagtctcaaaaaaaaaaaaaaaaaaaagaatgagggcaacttgttgttctgttagatataaacttaccataaagctgcaataatttcaaatgttctatcacagaaatagaggactacagacatgaaacaaaatagagagtttagacacaaacttatgttcatatgggaatttaattcatgacaaaagacatctcaaatcagtggggagtcaataaatgagatgggactattggttacccatttgggaaaaaaaatttaagtgaaatccttgtctcatatgaaaacaaatacaggccaggtgcagtggctcatggggttacatgcctgtaaccccagcactttgggaggctgaggcgggtggattgcttgagctcaggagttcaagagcagactgggaaacatggcaaaacaccaaaaatacaaaaattagccgggcctggtggcacatgcctgtaatcccaactcggcaggatgagacaggagaattgcttaaacccgggaggtggaggatgcagtgagctgagatctcgccactgcactccagccctccagcctaggcaacagagggagactctgtcaaaagaagaaaaaaaaagccataaaagtaccagaaaaaaatctggaatattttaataatattaaggtggagaaagccttcctgagcatgacttaaaaacccataagctataacataaagagtaataattttggctacattaaaatttaaaacttctgtgtggagaaagatgctatacacaaaattaaaacataaacaggctaggagaaagtgtttactacacagatatcaggcaaaaggttaatatctctgcctatatctatatcaccttctggaaactagtaagaaaaagatacaaaacccattcaaaatggagagataacatgatatggcaattcagggaagaaatagacaattagctaataaaggagaaaatatgcccaagcttactaatagttaaagaaatgcagctaaagcaggccgggtgcggtggctcatgcctgtaatcccagcactttgggaggccgaggcaggcggatcatgagatcaggagatcgagaccatcctggctaacatggtgaaactccgtctctagtaaaaatacaaaaaattagccaggcgtggtggcgggcgcgtgtagtcccagctactcaggaggctgaggcaagagaatggcgtgaacccgggaggcggaacttgcagtgagccaagattgcgccactgcactccagcctgggcaacagagcaagactccgtctcaaaaaaaaaaaaaaaaaaaaaaaaaaagaaatgtaactaaagcaatgaagtgccatttttaggttcccaaattaaaaatattggaagggttctggagaaacagaacctctcagataccttctgcaaattggtaacattttttatggggctagtttgtcagttaccaccagaatcctaaatgtctgtattcttccatgctgagaaccatatcctggagctagatttctccaaggtcttgcttccagaaggacctcaacttggccaaccagaggccttttctaaaacaccacaatccaaactgcaaacataagccagactgtgcaactctttatcacctgcccttgtaggatatcattctcaaccaactcttaactaaaaggtgcatgatatatgcttctcaaaagaaagacaagattatgtgagtaggaataatctttctttacagccagactgcaaacatgttaaagtaacggaaataacttttatgtgcactttaaacaaaatgtgcattcctttgacccagcagttcaacttttaagaatcttaaccttcaagaatacttggagacatatgcagagatgttcagtgcagcattgcttgtgatactgaaaaattaaaacaacctaaatgtctatcagtagggaatagatcttagtccatgatatacccatattatggattactctgtagcagatccaaagaaaaggtagctctgtatatactcgcacagcaagatctacaagacttactgttacatggagaaagcaagttgcagaacagggtttacagtataatcccatttttgtaaggaaaagaaaacccccataacaacagtgaaaacatgttatgaacaccctgtcatcatttcaaaattactggcctttttccttggtcccatttccttgcttttattaattcatttccctcctcctttataccttgtccctgtatccagctgttcagattttgtttagatccttttaataattagctcagataccacatcattcattcagcaaggattctgtcttgcctgctttagattaggccttgtgctgacctttggtggaatattggaatgaattgtatctgatcctgctctcatggagctgaagtctagaagggagaaaggcacatagacaatgacaccgtagtgtgatttgggatgggacagaagtaggcccagaaggctgccagatgaggggcaattaaccccatctgggaaggcttcctactggaggggacgtttgtactgagtcttggaagagtgctagctttccttcatccccttcctccaccagaaatggtcttgttcactctttggcccttccaagcaggatgacgtcataggggaaaaatagtggagtcagtacctttattcaagtccgagttctgccacttaccaactcggtgactctgggcaagtcatttatcctctgagcctctgtttcctcatctatgtaatgcggctaatgccaacttacctcttagggctgtctttaggattggagataatgcatgtaaggctcctgggtgactgtcagctctagaagaggagggactacctgtgtcttgttttcctcatagccaactgtgtagcattgaattggattcgatctcaaagctgtgtgtattagacggttctggagcaaagaatgggcctgaccatagcagggctttgggatgagaaggctgagaggagtacagggtacatgggttgcatcataagaagagagaaccaggtgcctggtcttgccttatataaaggtgatgcaggagggaaaataagagtaggcgttcctgggaaagggattccaagtagggagttctggccctggttcttggtcctcttctactgataccatctcctaatctcacagttcagagcagtgaggcatggtggaccactacttgccatggcattcatggcaatttcagtcccaactttgtcactcactagctagctgaccttgaccaactcacttcacgtttctgagcctagttccttatctgttaaacaggactcaataccaccaacatcatggggttcatttactgaatgagctgagctcattcagatgaatgcattcagaatctgagtggctggcacataatgggtactcaggaaagagtagctattattagtgttgatttcagtagatacttttggagtactgctgtgaccagggtctctgttgagtaacagttcttgccctccatgagttcccagtcactcagggagactgagaagggccctgacagaggagaacactgaagggtatggaagcccagaggaaggaatttggccctgtctggggctggtacaggtcaactcagcctaagagctgggtcttaaaggttaagtaagagccagggacagaagggtgaagtgtggaagagcattccaggcagaaggaatagcatacagcatatggaaaagaaacgggatgttattgggaagggccagaagttcctaacctggggtgcatgggtctcagatgggcttcaggaaccccacgaacctccggaaattgaatgcaaaatgttgcattcatatacctatgtgcattttttggtggaagagatggtccatggctttcattaaattggtaaaggggtttgcattcccctcaaaaagcttgagaaccaatattgttggtgacaaagtgtcagttgaatggattctaaataggagagtaatttggcaaaatttgtgttttagaaacatcacattagcagtcagtatgaaaaatgggttgtatgcagggaaaccagctggaaggcctaaactggggtattggcagagaagaaatggatttgagcagggctacggtgttgcacgactccagtgagcaccatttgttgagaagcactttaatttcaaattatagaatccaaatcctttgagagttattaatgagatagactcaatagaagtgtcagatgatataaactgttgtggatgtataaggtgagggaaagggaagaggcgaggatgagtcaaagttagcagagggccagagggacatgagtccatgccagggtgatagtgcaaggggaaaagggaacctctattaatgctcacccagcatccagagtccttagtctcagacatatttactaactttcatcctacccctggttctcagagatcccaagtgacactggcaatactcatttccctgcggattttgcagaggaattacttttgctttgtgagttaggtcaagtttcctgaagaaagctgtgtttaagccagtcattcaaggtccatgaggattctgagagttagagatgggggaggaggtgctgacagtgtccgcaaaggcctggaggtgagcaaggtgaaatcagacattggagggtgcagaggtcaggcttacctcaagcagctgtctgaagagtataggctttttattttattttattttttttttggtaggcagttggagagccatgaacagttcttgaataggaaaagatgaaaagtgacatgatcaaattagcgttttagaagggaaatgagggaggaggctatgcagtaatccaagggagagagaagccaaggtcgtgggcatagagccgaggagatggatttgagaggtgatcaggaggaagagaggactggagtcagagactgaagaggtaaccggggagagaggaggaggtggagatgacagaggctggagttcgcagtaagttcaagtgttcatgcctggcactggattcattcattcactgaatatttattgaatgccaggcactgtgttaggcactaggggtttagcactgaacagaacagatgcctgtcctgatggatcttacagtgagtgagacagaaaaataaataaacaactaaatgtctagagtgtatctgatgtcgataagtgctatgaagaaaaagctggggtgataaggtagagaatgttggggtgccttttgagagggagggcctctctgatgaggcagtatttgagcagaggcttgaaggaggtaagagagtgagccgtgtacctctcagggacgatgttccagatagaaggaaccgcaggtgtaaaggccccgaggcaagagtgtgtttggtctgtttggggagcagcagggagaccagtgtgatggggaaaaggctgaagaaggagtgagaggagtagaagatgagatggtaggggcaacatcacagtctatcttttagagctatttaggaggtagagtccacaataattggtgactgacttgctaagagggcaggaagaatctagggtgactccaaggtatgttttgggctcaggtgactggatgaatggtggtgccttaaggacaatggtgagatgctgagtcagaggtccctatgagagctgaaggcccaaagggccatcctggtagagctgtccagcaagcattgggctcgacgggtccgggacccaggagagggatctacacctgaagttatgaaatggaatgagatcactgaaaaagtgtggagtgaaagagaagagggccagagcagaattgggaaggggaaaccaacgcgtagggaaggagcccaggaagaaatgggggcggggtcagagcagtaggaggaaaagcagtgggggtgggctcacagaagcagaggaaggaaagggccatgcagaggagggccttgttaagagtgtcaaatgttgcagcctgggctagtaagccgagggcggaagagagtctattggctttaaccatcaggagggcctgggcgaccttcctcagaacagcttccatggagtggtgggcgcatgaggcagattggagtgggtcgaagagctcgtgggaggtaccgaagtgaagcagagatggccagtgtagacgggtttcttaagaagaagcttagctgtgaagaggagagagggacagagggggatgtgggggcagatagagggtttttattcccagatgggagagacttgagcttctataaatgttgataggaaggaggcaacagagggggagaggttgaaaacgcaggagggagaggggatgattgttgtggaggaggtaatggggatgggctccagagtccaggtggagagactggccctaaatgctagaggggccccctctttcttacagaggagcaaagcagtgatagtggtggggatacaagggtattgggggattggtgaaagaaatgcttcaggaaagttcaaagcaacaaatggagagccctggccaagggaacggatgctggagctggaaggaagcagagaatacttctggctaggacttccttaggaagtggcacttgagctgggtcaggaaattcagaaaggatggtaataggcaaagatctgtgcagagggaagagtattctaagtggaagaaacagaatcagcacacacatagagatgtgaaaaggccaggcatgctgatggaataatgaacaagctagcttgatgaaggctgggcatcagtgagtagggaacatggataccactataatggccgttataataatagttaccatgcactaagcaccagccttgcttagtacatatttgaattcctttagtcccactgcaccctgcagaataggtatttcctcagtttgcaggtaaggaaagtgtgtcctggaatggtgaagaaatggacccaaggtcatccggctagtaaatgatggggctggtattgaaactcaggtccgtctgattccatagcctgtgcttttgccatctaacaggaaaggcctggtgaggccatatggtgggagagccttgaatgccaacttgaggaccctgaactttatccaggaggcagtgggtgtctgagcagaagagatgcatgcttgaaggtgggctttaggaaggctaatgtggttcaagaagggagggagaagaaatcaggaggtgactgcagtgttagggggagaggaagcaggggcctcgcctggaaaagaggggagtgagcagtgggaatggaatatcacttgttcctcatgacagcctggagaggtgtggatcttctgtttttatagatgaggaatgggacactcagaaagggagggctacttgcccagaacttgcgccctgcttcatgtgattttgctgattcaggaagtccgtggaacaatgtgtcagagggagctctgagtctgagaaaggcgtgtgcgtgcgtgtgtgtgcttgtctgtgcatcagatggacagcaatgccttcctttcctttcccttcacttccctgtctgcgttccttcccacctcttcccattcttccagtctcctggattccataattcctgcatcccctgagccaaggggtctgggaatgagggtaactgtttccttgtctgtccccagaaggtcagccttgtcactcccaagtcacctggtcccctcccagcccaactgtctgtccatccaccatatgaaactgtagcccagcaccagtgaatgccacatgcagcctggcccctggtactgctcagcagcaccctagggataggtgcttgttcctgcagcgactcttctcccactgctgtggctgcttctgtgtgggcagacggccactttgggaattagattcagctcacgagtagttaacaataatcaccaccatgttcccattgctggtgtttgccagacacttgatatatgttctagttcttgcaacagtcctgggaggttcacatcacgagccccatttttacagacgaggaaactgaggctccaagagtgacaataatgcgctcaagggcatatagcctggaaccacttgtagagctgggatttgaacccaggtctgtttgcttccaaagctgtgggctttccgtactccatttccaagtatctcccattttcctgagcctgaaccttcaggaaatacaaatccttgtccttcaagagcagggtgggtttctagagatagtgccaagttcacccaaaggacctagtgggatgagtctgagacttggagctccaaaaactctgggttcaaatcctgactctaccacttacccagctgtgtgacctagagcaagttatctaacctttctgagttttaattccctcatctctaaaatgctcctctgcagagctgttgtaggggctaagtgagatgatgcgtgcaaaatgagagcaggttgctgttattatattaaaatgagggtcaggcacctggcagggttagaaagggagttgatatacgctgagggtgaccttaagactgagcccaggctgggtgtgggggagggctgtcccagcacactgagttgggtgtgaccctggataatccatcacactggcctccccaccctgacccccattctcgtcccaccttctggttccggtcctggcccttcgcgtatctcccctgctctgcaaactaatgcctctgcctctctctgtcacccaccgcctgtggcctctaccccgcccttcctggccccagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccccacccacccccccgcagattcccccatgggaccctgtcccctgcttcaggaaccagatgggcaagcatcgtgccccttcctccccccaccttcttcttggaattcccatccccactgctgtctcctctggactccagcccctgaattaaagagagctggagccctaggtccgactaaaatgtgggagaagcagagcttggagcttggagcttggaacctggatcctcccgtacccgcactcccacttcccaggcaccctggagcctgccactactggagaggtctccaaatgacatcccaaggacctacctctgtcctctgtgagcacaaacagagatgcagggtgcctagggctcagaggaccagacgggggcaggacccagcctgcctagttccctgtcgtttgttcccttgctgtggccattgctgccatctcctccactgcttgaaggcctcaccccatgccctctgccactcccatagtgctctgtaaatattatcaggaggaaaaggcctctcagagtgcgtgttgctgtgtacaaaggaatttccatcaataaaagctgatctcttctctctgtctgatgtatattccacccacccccacttccctcttccaatccccaccagggccttgccttctttcctatccagggctgggaataggggccgggaaagagagtagggtttgattcgtggttttgtcaacacccaggaggcactcaataaatgcatgaatgactcccaacacgggcaggctaaccttggatgtgtcgcatgacctctttgacatctataaaaaggagaagggttggattagagggtctccaatgactcttccagctgtgacattttgtgaatctgagatgctacagttttaagaagctatgattatgtgaatttaatagacaatgattcagtgacacattccactgcaattttatgatttctatttctacaatgcagtgattttgggattttccagtcctgtggttttaagattgcataattctaccatttgaacaaattctgatgatgcaattttaatattctgcaatgtttagattccttgatcgtttacttttaaggttctgattctacaactttagggatctctgaatctgagaggaagccatttccctccaatgcaacgaccctaaatattccctgcacctgggcagaggctggttctaagactccctggaggctctcagctggagggtggaagatgtcctttacgggtttgtaggactcacaccttccatgatgtgtctgaagtgggctcatacccccgacttttcctgtctgagcctttggtattagacaaatctgagtttaccttctggttctgccacttacatctgtataaccttgagcaagttttttcttctccttgagctttgttttcctcctgagtacagtgagaatatacctacctctctgggttgtcatgaagattagcaagaaagaacacaacgagcccagcataggagcttgtgcactgttgggcaagtgtgctgtgattggtggctcttgttttgattaaggcccaggtgagagttttctcctgtcttttctttcctccctcccttcagcatctctatcacattgaacctctaggtttcctagaacctcacctccttccctcacttattgcctcactcgctcaactcatctactcattcacccattcaaagtctcatttatttctcccctccctccctgcctgtctcccttatttactcttcctcattctactcaacaaagcattgtttgagcccttactgggtataagacctgacgctaaatactgtgagagatccaaagtaagacagaggccaggtgtggtggctcacacctgtaatcctagccctttgggaggctgagacaggcagatggcttgaggccaggagtttcagatcagcctgggcaacatagtgagatctcatctctacaaaaagatttttttttttttttaagcatgacagtggctgtgtcctctgcgagctctccatctcccaggggagatgagagatgagaaatcctttgggaaagtaggaaggatgcaaagggttaacatgattggacaggaacggcttcagtaatgagcacattttgttcctggcccagagaggaaggagatgtcaaggtgggtggggaggtgtggtgtccaggagggcttgctggaggaagaggtgcaagagttgagccttgaaggctggtaagggtttgaaaaggtggcaaggggtgagaaggcattataggagacagggaccgcatagacaaaaacctgggggagcgctccagggtcatgcaggggaatggtgggtacattactctgtttattctgctctccagggtgtgtgaatgtaggtgacctggggctggggacgaggagaccattctacccttccgctgaatggagagagaagcaagtgtgggggtggggacgggggttcaactacatggggggagggggcaagtcagggtcagatgaccctcccgacccgtgggcaactgaattggctgaatcgggcagagggcttgtgctgtgggaagggggtggggttttgatcagccgtgagagaaatatgtgtgcacgcatggcctccatgtggccggccatcctcacacatgtctttgcacaaggctctgcaggtctcacagttgtgagactgtgcacactgctgcagagctgaggaaatgtgatgatgtgagactgggtgtgaggaattctgagtgtgaggttgattgtgtgaagtggtgactttatgtacctggcagccttgatgtctgtgtctggtggatgtaatcacaaggctgggtgtgggtggcttttaagcacgtgaggctgtggcctttagggtgacagttgtcaggcaggatggtcacacacacacagacacacgtgatttctacctgtggtcttcgaggacccagggtggctgctgagtaactgctgtgtgcttagtactggcatgagtgccataggtccgcaaaggtgaatcacaccgggccgctgcccttgggaaacaggacgggggtgtggggtgggagacggacactttaagagagaaccacaagttagccaggaagaaagactgactgtgataatatgggtatgcataagacacaggggagggagtcactgaccctgtcatgttccgtgagcggcaggagtgagtcagcattgacttcccagaaggaccaacctgcccagggtactgcaagatgaagatgagctcacccagatcaagcaagtcggggggtgaaggggagacagaagacattctgggcagaagaaacaaaggaagagtatgagcatgggcttggttatgtggatcagcttgctgtagtctaggaattgcaagtaacctgctattgcctgtgacattgaggaacttacagggcagggtgggaggtgaggggtggggagacaggccagattcagaggggcttctgaagctaagagtgggatgctggccagaggtgagggggattcttgtcctgtgcaaccctgggcaagtcactttgactctctgggcctccatttgggtctgtgggattggatggttcataaagcctagtccgtccagtccatcccagctctgtgcatcttctgccacccttggctagccacatccatgagtcatcgctcttgaggtcaggagcttcttccatctaacctcagtccttcctgcttcctcccgggttgcttcctcgttcacccactccacaaatatttacccagcatgcgatcctttgtgtgccactgtgggaaggcacggggagatgaagaatgcgaggactgtaccttgaagggactgcttatagtgcctgggacagagggtggggtggtggtaagagcacgggctttgtgttcagatacacttttgtttgaatcttggctccaccagtgctgagcttcaaggctttgggcaggttacttcatctctctgtacctcagtttcatcatctgtgctgtcctcctcagagagaacaacccaaaccttgcagtgttgctcagcctagcaaaatgacaactcaataaatgacaactattatttttagggctgcacagcagcaaagctgggattcaagctcaggtcttgcgctcccaaagcccgtgtatgcagctcagctcctctgaaggctgctttcttccctgtcagttcctgtgccaagccaggctgggctagggcttagatccctgtgacactgggattgggcagcagaactagcttgcagaagaaatattggagggagaggtggctgcagtccccctgcctcctctctcccctgccactgggtccagtctcctggcccagtctgctccttccagaacccaaagcccctggtcccatccaggtgcaatgaccttcctcgtcttgttttcttgtctctacttccagtccgtcccgttccccccactgccacctaagttgtcatggggatagtcctcaccatccctagcttcctcttgccctcatcttatgatatccatggcaacagcccccattcgtttccatgacaactgcatcctgatcccatcccctgctggctgcctggttccgggcagtgccaataaagggaaggagggagagaagacctcccattagaagcagcatttgaggaggattagtgcccctgccatgggcaggccagccccagatccctgtggaacatcctacactgcttctccccatcttagtgctttggcacacaaggttccctcactcttcatctctaccaactccttccaggcaagacccagtccacaagcttcctcccccaggaagccttccgggcagcagaggaactagcacaagctttggggtttgaatctctgtcctgccacttgctagctctgagacctttggcagtcatttcccctcttggagtttttttcttcatctgcaaaataggaatcctaattcttccctcacgtttgccatgcagattaaataatgtgtggaaaatgcctgacacagggaaggtgcgcagtaagtgcgagtttatttttattctgctcaaccacccccaaacagaagggatctctctcctgcactcccccagcacttcctctgttccccagccctgataactttctgctttgtactgtggttatttgtgtagcatagcttatttccccctctgcagaggatgctctccaatttcccccacagaatagcccagcagacagcgcacatgggcgtgtgtgtgtgtgtgtgagtgtgtgtgtgtggttgtgtccgtatatgtgcatgtctgcatgtgtttgtgtctattttcttgtgtctgtggatgtgtttttgtttctaggtttgtctgcctttgcatgtgtctgtgttattgtacctctgcatgcatgtgtgtgagtgtatgtgtgtgtgtgtgtgtgtgtgtgtgcacatgcagatgttttgctcctggctgggaagagtccagagagggggtgctcccagaccgtttctgaagtccaggaatccaaagagggagttggttttgcttgacccctgcacagatgagaaactgagttgcagagaggaaaagtgacatgcacgggctcacacagctggtcagtggcagtcaggacctgagccttggcctgcccagcgtcttactctacaacaggctctttctctctctgtgtgtttgcatgtgtgtgtatgtgtgcgagagaaagagaagaagagagattttccatgtgatcagcatgtccccgagtgttgttctgggggctctgacttgagggattccacatccccagtgctgtttcttcagcagtatgtatgatgtcagaagcaacgccgtcaagcaccctcctttttttgccaggctcccttgtgggaggctgtgctgacagcctgatctccctgccactattccctttgcaaccaaaacgggggtgagctctcaagggaggaattgccaaagagtgcagagccaggggcagcacggagccgggagtgaggagaggcaacaagatgtcatgaaaagcctgggccctgggtttgaatcctagcttttttacttaatagctatgtgaccttgagcaagtttatgtcacctctctgagcctcagtgtcttcatctatgaaatgaggctaatggtgcctgccttggtaagtttcaagaattcaatgagctaagtagtgcctttgccctaggaattagaggtgacaacagggccctactgcagcccgagaggagcgggtgtaagacagcctgtgtggaggaggcaggcaggcatggaaaggcatacctgagcagagcattgaaggctgagcaggaggtagccaggttggggcaatggggcagagaatatatgaggtgggggtcaagtcaggagagccatccatggccacagtgaggaagttgaaggttatcccatggctgctgattcctggaacacccaagttagatcatgtccctcctctgctcacctcaatcagagcaaaagccaaagtctttattgtaggctcatgccctttccgatttggcccccatgacctctctgatcttacctcctatctcctctcattcactctgttccggccacactggcctcttcactgtttctcgaacatgccagacacagttctacctccgggcctttgcgctggctgtaccctctctctggactgctctgcctttgccatgcaacttcctctcacttccctcagcactctgcttatatgccattgctccagaaaggccttccctgagcaccacttctcaaacagcaccttttcgcaatctgctatattttccttcctagcacttcacccctacctgaaatggcaggatatatttacttgtttctttcttctgtaagcctccaaccttgtgccccccataatgagaccattctctgggtcccagccacacccattccctcactagaacatcacctccctgagaatgttctcgtgcattttgctcactagtatatttccagcacccagcactgtgcctggcatacagagggtgctcagttgttgtttgttgagtgagttatctggcgctgtggaagggttttagtgagagaatgaaatagttaggttagtacagttttgtttttgtttttgtttttgtttttgagacagggtctcactttgttgcccaggctggagtgcagtggcaggatcacggcttaccgcagccttgacctcctgggctcaagcgattttcctgcctcagcctccctagtagctaggaccacaggcatgcgccaccacgcctggctaattttttattttctgtagagacggggtctccctatgttgcccaggctggtcttgaactcctgggcttaagtgatcctcctacctcagcctaccaaagtgctgagattatgggcctgagccaccatgcctggcaatacttttttttttgagatggagtctcactctgtcactcaggctggagtgtggtggcacaatcttggctcactgcagcctccacctcccgggttcaagcgattctcgtgcctcagcctcccaagtagctgggactacaggggcccaccaccacacctggctaattttttgtatttttggtagagatgaggttttgccatgttgcccaggctggtcttcaactcctgccttaagtgatccttccatgtcagcctctggagtagctgggattacaagtataagccactgtgcccagctagatttgtacttttttttttttttttttttttttggagacagtctcactctatctcccaggctggagtgcagtggtgcgatgtcagctcactgcaacctctgtctcctgggttcaagtgattctcctgcctcagcctcccaagtagctgggattacaggcacacccaccatgctcagctaatttttgtatttttagtagagatgtggtttcatcatgttggccaggctggtcttgaattcctgacctcaggtgatccacctgccttggcctcccaaagtgctgggattacaggcatgatccacggcgccaggcctagatttgtacttttggtggtggtggtggtggtgggttttgtttgtttgtttgtttgtttgtttttagacggagtctcgctctgtctcccaggctggagtgcagtggcacaatcttggctcactgcaacctctgcctcctggattcaagtgattctcctgcctcagcaggagatttcaggcccccaccaccacgcccggctaatttttgtattttcattagagacgggttttcgccatgttgcctgggttggttttgaactcctggcctcatgtgatctgctcgcctcagcctcccaaagtgctgggattacaggagtaagccaccacgcccggcccagatttgtacttttgaaagctctcactggccacagggtgaagaatgggttggaagaggagatcggaggctgtggtaaaagttcaggagagagtatttcttagagcagcctcctgagcacattcattgactccctctggacggcagcttttattgagcacctactctgttccaggccgtgtgctctgtgttagctgggagattatcaaattctcttcctgagctgggattctgggagtcatgaacacaaatagctgtcatgctttgccaaagctaacctgtgccataaaaagcaggacagacatgtgctgtgtgtgggagctctgaacaggatcagcaataatttctggctggaggcgggattcaggagggcttcttagtggtggcatatgacctgaatcttgacggaactaggatgtgggggaatttctcagattgcagatggcggagacgatggggattgcatttcaagtggtaggtactgtatgagcagttttggaggtagaaagcagaggagcatttgggaaaagcaggatgtgggccaggctggaatgatgggtggatggaatagggggctggcagccaaccctgaagtatggcttaatgtttaagagtgtgggctctggagtcagactgcctggatttgaatcctggctctatcattagtagctgtgtgaccatagatatgttacttaacctctctgggcctcagtttctttatgtgtaaaatgaagataaattacagtacctacctcatacggttgtcttgaagagcaagcaagttattcagtgtgaagtggtaagaatggtacctaaatgtgctaaatggtctataaatattagctgttgtatcttggagaagcctcaaatgccagaataagggacttgggctatctcttctgagcagtggaagttatagatgatggttcatgcatacaggagacagttgatcaaaactgggcttgagccgtgtgctgggaggggaggtttgagagattaatgggcaagatcctgcagtcctggcagggaggagaggaacatcttggatgccgggggtgggctgagctggggctgaaccctggagtgggggtgatgtcagggccaccgccccaggcccaggaggagagagaatttggggtggagagcgagcgatgggtgggagctctccccagggcggagccgagctccacagcgctgcagcccgggaccgggcctcgtgggcgcagccttcacaccacatccagcccccagtgcaaagcgctctgctgcaaggctggcaggcctgttgcagttccagctcctgcactggtagggtcccccccagtacctaccccagcccatttctgccctttgcctttgcctctgccgaataggggctggggagtaccccttcacctgtttaccagccaagagcctccaaccttgtgccccccataatgagaccattctctgggtcccagccacacccattccccccacagcctcctccatgcctcacctgcgtgttccttcccgcccgactccttccctgtcttccccacctctgtggctcttcaccgtgcaggctcggctcaaggcgcctgggctctgtcgccacctgggttccctggcagcctggttgccatggcaccatgggagcagttctggtggaacaacagctctgggaaaccagggcaggcaagacccggggcccagctcctgccacgcgtggagactcccctgcccccttcccccagctgagcagaggaggccatgaggagaaaaaggaagctgccccgcagggctgctctttacctgtgaggatgctggatgggaggcgcctcccactgttgctgctcgccctgccctgctgctggccctgccctcgcaaccagggaaccctgggaactggcttggcctggcccggagtccaggcaccagggggcaggggccaggctgcaggggacagggctgggcggatgaggggagagctgtgtgcaggggtgggcctcacacagctgggacagggctgggagggggtggcgctttgaaggagctagtctggggtggtgctgggaatcggactgggagggaaatcacagcgagcactgcgttggggacaaggccaggaggggatggagctgtaaggggaagaggtctgtggggaggggtggagctgtgagggggcagaagaaagggcatgaggagacaagactgggaggagagtggtctaggggagaaggctgtgaggggtgaggaggactggggaccaggcagagccttgagggaaaggagtctaagaggatcttgccgtaaaggcaggggggctggaagggaggggacttgggtgggagtggggagacgtccaagagctaggactcaccgtggcctgtaagtgttgggtccctatatctgtgaggaagctggggtggatgggatggggggcagggatctggctcacccactctcagtatggcccagtaggcccctgtcctgtccccacatcctggctcatcttatctcatccccacagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtgcaacagaggcatctggttgggaatgggagtcgggatgcaagagagcgccaggggagggtttgggatgtggctcttgggggtggtatcagggagggataatgaggctggaattggagaagactggcccaggacccttcaccccactggggatgcactcattcaccacccatccactgaggcttgtattcactcaagaaacatttactgagctccctgcccgggtcctggcgatgtaaagatgaatgagtcctggatccagtccccaaaaaactcagtctaacaggaagaacacacatcagttgaccttttcagaagagtgccatacaatagattgtttggctaaaaagaaaggtggagggaaaacaaaatactacatataggaaaaaactggaaggacatatacaaaaacatataccctacaccaaaagacatattctagttatgcttaggtgtttggaatgtaggtaattcaacctacctacctaccttccttccttccttctctgcctttctctctccctctctccttctcctttctcattctctttcttcctcctttctttccttcttgctctccatttatttctaccttgctttctttttttttggcttctctgtttgtttcctgttttcaaataatcaatatgttcttcttgcaaataagaaaacaaaacataatccaatcccatttgactagtgttatctgaaattcaagtgaggagacaacactgagcacctagcctggcgctctcggtggctgtaagcagtcagccatgattccagtgggggtggtgtggttgagtgcctagggagatgaggctgccatgactttctgaccttgttcccctcgacccttctctgccaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtcaggatccctgaaaaggacctttcttccccatccccgtgttctggctactcctgctactttttacctagattgcaaactgaaagaagttgcgtgacaggcatttaataacagcaaatagctaccatttgagttgggactgtgagaataatgagaaagaactggtaagatagaaattaccttttttttttttttttttgagacggagtttcgctctcgacacccaggctggagtgcaatggcacgatcttggctcactgtaacctctgcctcctgggttcaagtgattctcctgtctcactctcccgagtagctgggattgcaggtatgtgacaccacgcccggctaattttgtatttttagtagagacagggtttcaccatgttggtcaggctggtctcaaactcctgacctcaggtgatccacctgccatcacctccggaagtgctgagattacaggcgtgagccactgtgcccggccagaaattacattgttaaaacaagcaagttataaatatgggtgttccatgtcgttcccttcttgtgggaaaaaatatgtatgggtgtatagaacaaataagaaaaaagttctcactacttggaacttgatctactataaaataaagcttaactcacaggtagtgagctcctactgtgtgccagtgctgtatatgcctcacagcagacctgtgagacagggattattattcccatttaatagaggaggagactgaggctaaggacctggaattggtccttgtcctcaaggatcccagggcagtgggaaatggcagacatatgtgtgcattactgtctcctgaagtagagtgtgctctgagccatgagaaaggctatagtataatgtatagtaccttgggaacccagaggagggggaggaaactttcttctgggagaaccacagaaaacctgtttgagaaaacagcattggagctggaccttaccagacagaaaagatttagcaagttagaaatacttgggagggtgttgcttacataggcgttgcatcagcaaaagtgtggagggtggaattgtaatgcagtaaaggtagtgggtgatcgttgtaggcttggggtgtgtcaacatacttgcccaggtgtgaatcccagttctgccatttcccaactgtgtggccttggcaaactgtttaaccacactgaaacatgatcaataaaatggagagaaaataaaatggagagaaaacccttttagagctgtttggaagactcggtgcaactatacaggtaatatatatgaaaacacctagcacgtagtagctgctaagtacgttagttttcttcctaaaaccaagaaggtacttggtagagattgttgaatgaatggaagaagctttataagagaaaaagtcaccctgctctaacctctatgatctggccttgccatcagcctgggcatgcctccttggagctggtgaagaggtggagggaaggacaggagtattgaagggaagatctatatcattcgtctgttcattcatacaacaaagatttaattgaacatctcttctgtgtcaagcaatgtgttgagctgagctaaaaagagagaaaccaggcctggatccctccctcaagggaggaatgggaaataggagatcagtctgggaagcaggtctggtcccagctctgagtgctattgaagtctgatggggaagtatatctgttatctgttgctgtgtaacaaattacccccaaatttggtagcttaaaactgacccaagagagtgagcctaaacaataaacatttattatttcatacagtttctgggtgccaggaagctgggaatggcatggctgagtggttctggttcagggcctttcatgaggctgcggtcaagctgtagggagagcccgcaatatctgaagattagactggggctggcagtctgctttcaagctcacccacttggctgttggcaggaggattcaatgcctcaccctgtgggcctctccataggactgttcgtgatgcggctttccccaggttggggggtctgagagaaatagtacaagtgacaagcgaccaagagtgctcaagatgcaagctgcagtcattaaaaaaattttttttaatgttttaaatttttaaaaaatgttttgcagtttttttttttttttttaataaattttttttggccaggtgtggtagctcatgcctgtaatctcagcacttcgggaggccaaggtgggcaggtcacctgaggtcaggagtttgagaccagcctgtccatcatggcgaaaccccgtctctactaaaaatacaaaaattagccaaacatggtggtgcgcacctgtaatccctgctactggggaggctgaggaaggagaatcgcttgaacctgggaggtgcaggttgcagtgaggtgagatcgtgccactgcactccagcctgggtgagagcaagactctgtctcaaacaaacaaataaaaattttagagacagtatcttgctctgttgccaggctggagtgtagtggcgtgatcatagctcactgcagcctcaaactcctgggctcaagtgatcctcctgcctcactctcctgagtagctgggactacaggtgtgtgccaccacacccagctaatgtttttattttttgtagagatagagtctcgccatgttgcccaggctgctcttgaactcctgggctcaagggatcctcccatcttggcctcccaaagtgctgggattacaggcatgagccaccatgcccagcctctgcagtcttttaaaacctaatttcagaagtgacatacattcgcttctgccatatgctgtttgtcacacagactaactctggtacaatgtggtaccctagggtgtgaataccaggaggcagggatcattagcggccagtttagagtctggataccacagggagagagcattaccagctgtggtccagatgctcaaggtcaaatgttatggatttcctaagagaattcccacagaggaaactgggattttggtttactctgggggatggcagaggcaagaatgtggcttgaatcagggaggaggtaacgtttggcttgagtctaaatggacacaaaggaggtattggggtgtgagctgagtggggaacttgtgggcattagtctcagctcctgtgagctcacaatggttccctgggagtcattttacagaccacagagagcctgtcagggctgggggaggggaatccaccctccttgctgacctaccaggaagactccccctttttccttacctccctccctcattcccaccttccaccattcttccctttatctttctttcttttctctccctttccctcctctcctcccccccttgcacaggtaaagtctctggctgaatccatcgacgaagccctgaactgccacccgtcagggcccatgtctgaggagccagggtcagcccagctggagaagcgggagtcaaaggaacagcaagaggacagctcagccacatccttcagtgatcttcccctctacctggatgacacagttccccaacaatcccctgagcgactgcccagcacagaacccccaccccagggccggcccgagttctgggcgccagcccctctcccgccagttcctccaccagtgccatcaggaacccgggaagacggtagccgtgaggaaggcactcgcaggggtcccgggtgcttggagtgccgggatttccggctgcgggctgcccaccttcccctgcttaccattgagcctcctagtgacagctccgtggacctgagtgaccgctcagatcgcggctctgtccaccgccagctggtgtatgaggctgatggctgcagcccccatgggaccctgaagcacaaggggccaccaggcagggccccgatcccacaccgccactacccagcccctgaaggcccagccccagccccaccagggcccctgccaccagcccccaacagtggcactgggcccagtggtgtggctgggggtcggaggttggggaagtgcgaggcagcaggcgagaactctgatggtggagataacgagagccttgagagctccagcaattccaatgagaccatcaactgcagctccggctcctcttctcgggacagtctaagggagcctccggctaccggcctgtgcaagcagacttaccagcgggagacaaggcatagctgggactcgccagctttcaacaatgatgtggtccagaggcggcactaccgaatcggcctcaacctcttcaacaagtgcgtgctccccgttctagcctgcttaccccttcctaccctgccacatgcacttgggttcctgggacagaactccacacagtgatccccgttctgccatcctttcattttgtggaatggtatttctccccagacattcagggaagaggattggcaacagggtggcagagtagagagtcccttaacacacctgggctcgggtcccagtactgcccctggctggctgtctgatcttgggtgagatgaccccactaaatggattctgaaccttgtcctccccaccttccctttttagaggggaggtgatatggtgtagaaagagccctagtctgggaaacaggagacctggccccctcagtcggcctttggctagactcactgcatagccctgggcaaggtgcattcctcccctgggcttccatttttccacctaccactagcagaatgtgtatgtaagaggtgttgggggcagggtggtgtgctggacccttcagtgactgtgactaagctctttctaggtgcctggtcttctgccaggtgtttaggagtgaggtgggagtgtgacatttgattagaaaataattggaaaatattagatgtaattggaaaacattagatgtaattggaagccattacttgaatgccttacatctttatagcttattaaacactgccacctatatttaattcttacaataactcagcaaggcaggcagtagtgttcctattttgtagataaggaaccaaggcttggagaagcaaaaggaattgtccaaagtcatacaactgggaagtgatggatctgagactcctatggcatcagtcccttccaaattttaaccttgtggggtcctaaggttctggggttctgaatatgggatagctgtgacccagattttggcccagctccctggaaatctagggggcaccttgtctacagaaacactcagagaaagttggtgatacctgcctgagtgggatgtgggacgtggaacaaagtaacctcttcacttcttccctactctgagggtctgtgactcagagggaaggtgctcagccctctcctcggttcttgctgggaatgtcaagcctggcatagagcaggctctcattagatactgattttctttcaattgtgatgtggctccagtgaagggggatgttgggttgaagataccttgggattttgaagctccttgaaatgggcaagtggcttcttctccctgggcctcagttttctcacttgtgccatgatgggattggatcaaattatgtatttgacttcgttggtcctctgaggccggacttagttgggcccaaaattagttcaacaaatgagacagagagcacagttccaggaggacagtcatctcatctacctctcctctttctgcaggaagccagagaagggtatccagtatctgatcgagcggggcttcctgtcagacacaccggtgggagtggctcacttcatcctggagcggaaaggcctcagccggcagatgataggggaattcctagggaaccggcagaagcagttcaacagagacgtgttggagtgaggaccccaggatggggcaggctgggccagggattcctggaaaaggacagcaagagggaggaagggggcagcctgtccctttagctcagataagcttttcaaaacaggatgaatagaccttcctgcccctgtacccttctgccccaaaggggtctgatcttgtttggctctattcctaaagtcttctgggtggccctgggcaagacatgctcatcctgtagcctgttttgggcctcagttttcctgtctctgaaatgagtggcttgatggaaaggacctttagtgaccacgtgccttgcctcaattttctgagatggatttgatttcaaacattctgtcctcatgtgtacttgctcgggccacaggtcctgaatttgagagtctatcagtgggggtgttggtccatttgagcaggtccaggtgggtcagaggttttctgcagaggaattgaaagcgccacacctccttctttgctccttagctgtgtggtggatgagatggacttctcctccatggatctggatgatgcgctccggaagttccagtcccatatccgggttcagggtgaggcccagaaagtggagcgactcatcgaagccttcaggtgtgcctacctcccactcgcgaagctgcccctccctcctgtgggcatcgacgtagtatgtgtttataagtcacttctctgagcctcatactttcttcaccataaaacagagatgataaatcctatcttgcaaggcaattgtgaggatcagaggtagtgcatataaagtatctagctcagcctctgggacatgggcattcgataagtgacaacaacatcagcaataacagctaacattcacggagcacttactaggtatcaggtgcagagctgagcactttacatgattatttcaccgaataatcacaaccaccccataaagtaggcacttctgttattattcccattttacagatgagaaatcagaagtttagagaggttaagtaacttgcccaggctcatacagtgaataagtggtagaaacaggatttgaactcgtatgtgtctgagtccatgatccatccatgcccttaaccattttactgtactataaatgctttggagatcagatagactggggtctaaatcctggctctgccactttagggtatttagaagagaaacaggagttgctgagaacttgtttcccacaatgggggaaggatttgctttgcagtcagaaataactgggttttcatcctggcttcaccatttaccagctctattaccttgggcaagttacctcgccactttgagtcttagtcacttcatctgtaaaatgggactgccaatagctaccttgcaggattatgataggattacgtgaaacaacgtacataaatcccctggaagagctctgtaaaaggtagcgattgtgatttttacatgctggtctaggggaagctctgaagaggacagacccagagatcaagaaagtatttcttgcaggaaagggttgctggtgccagactgggtggatggtgggtaggcagagatggctggttcctgagtctggctttgacccctcctgccctgcagccagcggtactgtgtctgtaacccagccctcgtgcgccagttccggaacccagacaccatcttcatccttgcttttgccatcatcctcctcaataccgacatgtacagtcccagcgtcaaagctgaacgaaagatgaaactagatgacttcatcaagaacctgagaggtgacttccctgtcagcttttcctgcccttcacctggaaagggaaagtggggggtaaggggaaggatgcaggagatcccatctgttccttggaaattaatttgtgatgctgtcactttctgccctagctggatgttcccaggatattcacttattaattcactcaaatcgtcatttgcccattgtactgagcttctactgtgtaccaggtttctaggtcctggggttcaagcagtgaacatgatagattaaagtcctgactcttacaaggctttactctgattcattcattcattcattcagtaattcacttgtcctttcctcgctccttctttccctctcttatttatgcccatgaggactcatttaattattttaggtaccttttcctctattcatgcattcatttatcactcgaccaaacaaccagccagccagtcaacacttagcgcttagtgtgtgccaagccccatgatgggtgccaaggacaatggaggggaatctgccatactccctgttctgagagagctccctgtgtgtgggagaggctgacttgtagcacccagataactaacataagacagaaagtgaacagtgacatcagagaggccaaaagtgcagtcagagctcaaaggagggagagcccacctctagctagcttcctggaggaggtagtatttttattttaaggtgggtcttgaaggcatggagaaggtgacacaatagagatagaggagggcttacctagcaatgagaataccaaaggcgcagaggcaggaacatttattttctttagggaacaattgagggctgggtacgttggctcacacctgtaatcccagcactttgtgaggctgaggcaggtggatcccatgaggccaggagttccagaccagcctggccaacatggggaaaccccatctctactaaaaatacaaaaattagcaggcatggtggtgcacacctgtaatcccagccactcaggaggctgaggcaggagaattacttgaacctgggaggtagaggttgcagtgagctaagatcgcaccactgcactccagcctgagtgacagagcaagactctgtcttgaaaaaaaaaaaaaaaaaaaaagaacaattgagatgaggtcattgatgggttgggaaggtcccaatatatgaggttccaatatatggaaccaatatatgagggccttgaatgccagatgaaaggtgtcaccttgctctttttgcttattctactgatgtcgagccctgcctatcaccaaagagcagctactaaaaatggtacagatgttaagattatttaagcagaaaagaaagagggaaatagagtcaaagaaaaaaagcaaactgaacacaagacaaattggctgcccatcaggtttgtgccgctgtggctgctctggtaagaaagtcagtgcgatgtagtatgttcctttagcacctgtccaaggaggagatgtgacatttccaaggaagaaaacattttttttgttttctgtttttttattttatttgttttttttttttttatttttagagacagggtctcactctctcacccaggctggattgcagtggtgctagcagagctcactgcagccttgaactcctgggctcaagcgatcctcccacctcagcctcctaagtagctgggactataggcgcgtgccaccatgcccaactaatttctaaattttttgtagagacagggtcttgctaggttgcccaggctggtctcaaactccttgcctcaactcggcctcccaaagtgctgggattacaggtgtgagcctccacgtcctgcccagaaaacattttctctagtagaggatttagagagaagagtgagtgggtttcactcagcaatcagaagtggagaaggatggtgaacatgggaggagggagttagatcagaggccatttggagctgtctcctagaattttgccatcattcattcatccattctttttccctctctctctcaatatatgtgtgtgtgtgtgtgggtgtgtgtgtgtgtatgtgtaacttccccctctaattattaaataaataagcaaataaatgaaggtaatacatactttatttcagaaatgttggaagattcagaaaattagaaaatttctttttatcacccaaaatgtgccccctagaggcaatcatagttaatgttttggtgcgttctaatcttttcccccatgcatatgtaactttttatatagttcagatcataccacacatgcaatttatcttactcttttcccataatttgctactgtaattttctcatgctattgaaatgtttttgtaaatgtcaagtttttaatagctgtgcattatcttattaaatggatatactatcctctattgttaaaatttaggttgtttcaaattgtccccataagtaacacttagtgagttttttttttttttttttgagacagggtcttgctctgttgcctaggctggagtgcagtggtgcaatcatggttcactgcaacctcctcctcccaggctcaagctattatcccacttcagcctcccaagtagctggggccacaggtgtgtgccaccacacccagctaatttttgtattttttgtagagatgggattttgccatgttgcccaggttggctctcgaattcctgggctcgagcgatccacctgcctcagcctcccaaagtgctgggattataccacgcctgccctagcattcttttttttctttttcttttttttttttttgagacagagtctcaatcttgttgctcaggctggagtgcagtggcgcgatcttggctcactacagcctctgcctcccgggttcaagcaattctgcctcagcctcccgagtacctgggactacaggcacatggtgccatgcctggctaattttttgtatttttagtacagatgaggtttcaccatgttggccaggatggtcttgatctcctgacctcgtgatccacctgcctcggcctcccaaagtgctgggagtacaggcgtgagccaccatgccccgcctgcactagcattcttgcacatacctcttgcacatatttctgagtagttccttagggtagattcctagaagagaatcactgggtacaaacatttaggttcttgccaaattaccttccaaaagagttatgttaccatacatgcccacttccctgcactcttcctagcactggatttcattttaaattatttttgctaattaggaaggcaaacaatagtatctgattgttttaattacagtgtattctgagttgttgagaaaaaattccccactctggggaagatagcaactggctgttgtactgaaggacaccctccctgccccaatcctggctaaggggccgagggtacccattgaccctcagtcctgactatcgtggcccgtgcctgggtgtgggggtggtggagcacccctaccacccagtgcccataattatgtgacatatccctgtgttactccctcccccaggggttgacaatggtgaagacatcccccgagacctcctggtgggcatctaccagcgcatccaggggcgtgaactgcggaccaacgatgaccatgtgtcccaggtgcaggctgtggagcgcatgattgttggaaagaaaccagtaagtgccttgggaggctgcagaggggccagggttcaggtctgcctctgccactaagtggtaagtcactgcacctccctgagccccaggtgccctttacctgcaatacagagtgggtgataatgcattcctcagaaggctgtggtgcagagtgaatgcatcgagcacattccaaggcccatagtgggtactatataaatattagcatccttttcacctccggctttgcctgtccatcctaagtgaagagccaagctaatggttagcagaaaaccaaagtaagaacacactttaggccaggtacaatggcttgtgcctgtaatcccagcactttgggaggccgaggtgggtggatcacctcaggtcaggagttccagaccagcctggctatcatggcaaaaccctgtctctactaaaaatacaaaaattagctgcgggcgtgatggtgcatgcctggagttccagctactcaggaggctgaggcaggagaattgcttgaacccgggaggcggaggttgcagtgagctgagatcgtgccaacgcactccagcctggggccacagagcaagactccgtctcaaaaaaagaaaaaaaaaaagaaaacgctttagccaacaaacatttgtggatgcctttccactgagcccagcatttgctgggcaccagagttggtgctgggcattcatagatatgaatcagacgtgttctctatccttgggggcactcacagaccagtcggggtgtgaaacaaagacacatataatacttctgctttatggtccagtttaggagaggagaaaggagagagagaccattttcagcctggagaaatcagggaaggcttcttggaagagatcattttgggattgaatttttttttttttttttttttttttttgacatggagtttcactctgtcactcaggctggagtggagtggcatgatctcggctcattgcaacctctacctcctgggttcaaacgattctcctgcctcagcctcctgagtacctgggattgcaggcgcccaccaccacacccagctaatttttgtgtttttagtagagacggggtttcaccatgttggccaggctgatctcgaactcctgacctcaagtgatccgctcgcctcggcctcccaaagtgctgggattacaggcgtgagccactgcgcccggccgggatggaaatttgaaagggagttgaaatatgaccatgcagagctgggcaagaaagacattccagacagaagggcaaaggcaaggtagcagataagtttaggtcttagttgctgataccccttgtgtcagagtgacacacatgtatgagtggtaaacttcttgcggttgaaagttaaggtgccaggaggcctgaagctgatgggctggccttgctgacacctgtttcttcatgcctgtctaggtcctgtctctccctcaccgtcgactggtttgctgctgccagctctacgaggtgccagatccaaaccgcccccagaggctagggttgcatcagcgggaggtcttcctcttcaatgatctccttgtggtatgagcactgtgggggaggagatgggagggagagagtgagcttgacacctaagtctggtgtgaaccatattgatgtaggtgtgtggtgtgtggagtgtggcgggcgaggtgttctgccatgccatctgcatggtctcaggcaaggcccaggccttctctgcccctccttttcctcacagatgcatttggaggtagtaacagacacacagggacagaaaatatgaggaccaaaggagatgacagacttacaacctgggaagtggtaggaaatatccctgtccacctcaatagcccatagggttgtgtgaagaggggtgaacctgcgaccccccaggtcagtctggaaatcttcagtaatcaagatgcttgaagtgggctcggcactgtggctcacacctatagtcccagaactttgggaggccagggcagtttgaatcacttgagcccaggagttttgagaccagcttgggcaacatgtcgaaaccctgtctccacaaaaaatacaaaaattagccgggcatggtggtgtgcacctgtagtcccagctacttgggaggctgagtcgggaggatcacttgagcccaggaggcagaggttgcagtgtgctgtgatcgcaccactgcattccaacctgggcaacagagccagaccctgcctcaaaaataaataaataaataataaaaacaaaatttaaaaaagatgcttgggccaggcacggtggctcatgcctgtaatcccagcactttgggaggccgaggtgggtggatcacctgaggtcaggagttcaagaccagcctggccaacatggagaaacctcgtctctactaaaaatataagaaattagctgggcgcagtggcgcatgcctgtagtcccagctactggggaggccaaggcaggagaatcgcttgaacccaggaggcggaggttgcagtgagctgagatcgctccattgcactccagcctgggcgacaagtgaaactctgtctcaaaaaaaaaaaaaaaaaaagatgcttgaagtgattcttcaaactgagctcattacaagtagagatgtttgtcttttagggatgggactcttaggactttgcaggttggaagggactttcagggtccagcttcctagatggcccactggatgtatgactgcagggacagaaagccgccttcctctaaggcagccagttgccttgttaggcagctctgactgctagaatttgtctccctgtgggtttcttccagccatctgcactcaacccttggcatcacaaagaacaagtgttgtacctctgctccaagacagctctccagggatttgaggactctcttgatcctgttctccctgtggtcttctctcctttagagcagggtttctcagtctcatcactgttgacatttggggctggataattctttgcggggactgtcctgtgcactgtaggatgtttagcagcaccctggtctctacctactaggtgctagtagcaacccttcaaccaaaaatgtctccagatgttgctccgtgtcctctgggggcaatatcacccccagttgagcattgctgctttagccgaagtatttccatgctccctctgagccttagtttcctcctctgtgaaatggaactaacccctacttcacaggattgtcatgaggatgaaatgaaataagaggttatatgtggaatctgccctaccccagggagtacctggcccacacagtcaatgtgtagacatccctcaggtactgaaactggtgtatgtccagctctatgctaggcactgggtatgccaggatgaatcagacttagtccctgttctcagggagctcacagcccaaaggacctaaaaaagtgctttgcgtcattgtgccatcctgaaatcaaaacatttccttttacgagccacttgcagaccgcctgaggtgtttgcagcctgtgttagttgagtccagagtgcccaagtactcgacaaagatattgggttgttgagaggaagacttattaactctctacatgggttcagcagagattgccattaagtgcaggctctggtaaggcctggtgacagaacccgacaaccagactcctgccctccagtccagcagggggcgatcacacactcagaggactagcatagtgcctgacaagggaaaggcactgaatcaccattctggagctcagaaaaggggtttacaaatctctgtgggatgttggagcaggcttcctggaggaagcaggattcagttagtttctggaaatgtggtaaatgtctgtggtgcgtggtcattacatcaggaacttgcgttttcttccatgtctcccattctgtccctcaagcttccattctccccagcttgtgggcatgtgtgtttgtgtgtgtgtgtctgttaatggggtgggaggggagggtggttaccagaaataggtgccacgtggaaatcccccacccaaagcgctgcctcttgtctttttcccacccctgccaaaggtcaccaaaattttccagaagaagaagatcttggtgacgtacagtttccgtcagtctttccccctcgtggaaatgcacatgcagctcttccagaattcatgtgagtcccttcttggatcccagctcctgagagtctatgtcatggcccccatgctcacccgtcatctataccagctccagttttcggagtcccttacaaccggactaagggtctccaaagcacctacttggtcccaggatgaggggcaggccagggtggagtatgacttgggtctagcccctggttagctcatggtcttgcagagaaccacagtgcatgtgttctctggtgggccaaagagacggtgatcatgctgtgctctgaaggatgaaccaggaggagctttgttgcgtggtattcctggcagcagaagcaatgtgagttgaggcagaggtgagaaggaaagggtttcgagagagcagtgcatagttgtgtgcctttacatcctgcagtacagggagtaagagggccacagctaccaggagtttgagggctttggggcaaaggggagctgctaaacatgctcaagcagagaagaggcatgatcagagttagacagtagaaaaattatttcatgggctaggcatggtggctcacacctgtaatcccagcactttgggaggccaaggcaagaggatcgcttgagcccaggaattcgaaaccagcctgggcaacatagtgagaccccatctctactgaaaataaaaaaaaatctgcgcatgtggtgcgtgcccatggtcccagctacccaggaggctgaggcagaaggatcacttgagcccaggagttcaaggctgcagtgagccatgatggcaccactgcactccagcctgggtgacagagagatgttgtctcagaaaaaaaagagcagaaaagaaaaattattttatgtatgagccaccttgcaccagtcccaacagaggtgcccagtctcccctttctccacagattaccagtttgggatcaagttgctgtctgcagtacctggtggggagcgaaaagtcctcatcatcttcaatgcccccagcctccaggaccggctgcgctttacatccgacctgcgcgagtccattgcggaggtgcaggagatggagaaataccgtgtggagtgtgagtagcccagccatgtctcctccctgctctcctgaaacagtaccctgcagaaaccaagaatcctatcctcagagaatctcagagttgagggttagcttgtccaaccttcccatcctcatttcaagaattcttcagcctctgcttgaataccttcagtgacaaggggctcattacctcccaaccccattattatcctgaactctaattatgagccaactattccttctagtgaaaggtatcagggagaagaatcagagtattggaggtaggactatagttttagatcccaggtatactactcattatctgggtgaactgcagcaaattgcctaacctgccaagccccagtttcttcctatacgaaattggggtaatgaagtctccttcacagagtcatggagatgaaatgagacaaggtagccgaaatgtcccaacacatcttaggcattcaaaaaatccgtatttcctgtcccaccctctctcctcctctgcccacatatcaattcctgagctgaatcccagtgggctatcctctcagcccccaggggccacaccaagtcattttgatcatatatatataatggaaaatagtgattacatctcattcctcccgatgccctccaagttttctcttctccaggctaagcagtcacagttaagtaacatggtgttaaggagaaagaggcaggcagacagagacgaggcggcggacagctccttggtgaggccttcacagctccagggccactctacttctcagcgaggcagggatagaaatttcagttcaccagatcctttgagaccctggggaaatcctgagagagggattagtagcccaagacgaggggaggccagtagacacgtgtttctatgagctccgtggggaggtggggctgtaggaggccggaagcacccaagctctggaatcaggcagacctgcttccagaatgtcggctctgccatttccagctgtatgaccctgggcaagctctaagacttctcggatactcagtttcttcctctgcacaatgtggatgctaatactgacctcagaactgttgtgaggactgagagagatcaagtatgtgtagcgcccagcatactgcctggcacataataagaggatttgattcctgtcagtttcctgctcctgcccttccaggagcccctctgctccggagcaaggtatctgagaactgactgaactctggaaagattgccctttgccataggctagaagggccttaccatccttactgtgaaccatctgccatgaagctcttttttgaagggcaggggtgctttgggagacctgattgcaagagggcatgggaggggagaagtcagaagggtgaaaggaagggaaagggaacagggagagcaggcaccaagagggatgaagggaaggctgagcaggaagggagggtgcaagacaggagctgggcactaagggtgcttcggtgatggagctgcagttttgggggagacaagggctggtcgtccaaggggcaaaacacgaagcctggggacagagggagggaggagggaggaggaaggagaatggcccatggagggctagggtcagtcagatgggctctcactcctgttcctgacctttgctccctgtctccccgactgccacccagcggagctggagaagcagaaaggtatgatgcggcctaacgcctcacagcctggaggggccaaggactcagtgaatgggacgatggcccgcagtagcctggaggacacttacggggcaggcgatgggctcaaacggggcgcactcagcagttccctgcgagacctctctgatgcaggtaagccctctgggcccctgccctggctggggagacacgggaccgggtgtcctctttgcctcctgtcactggccgccagccttccctccacctgccacacatgcacgcaccctgccttcacccagagccctgggcgctgcgccacagggggcctgggagccaggtcagagcagggggagcccagcttttgggccagggagtgtgaagtggggccacagtcttggtccctctctctcgctgctccccctctcctcctcttctccctcttctgtctctcctgtacctccactcctccttctccatcttttcctcctctttctcctccttctccacctctcctcctccccgcctccccctcttcaatgggggaaagggataatggggtgtctgtccccgggaggggcccagtcctggtgcccagctctggagcccagcagggtagggggggggttgctgctctgacgctgggctccttgcttgtgggtgcagggaagcgggggcggcgtaacagcgtgggatcgctggacagcaccatcgaagtaagtgccagctcctgccccactcgtcctctgcatgagccctgccccggccatggagacccagaggaggaggggacctgttgctccccctcttccctgctgggaaccatgcggctgcctctcccagccaaccactctctccatctgtcctcaactctgtctgtcctcattctgcctgtctctcagtctgtcttccactctcccgtgccccctctcaaccccagggccgacggcgagtagggatgcccttggagttgggccacgagaagctcttacctccaagtcctgctctttgaccctgggcgagtcactctgcctctctgggcctaaccttttccctgcctgcaaaatggggatgaggaggaggtactgctaatttctcctctcccagctgaggctcagctgagatagtggatgtgacagccgagctttgcaagctggggagctccacatacgcgtaccggactgtgatttggtttttattacaacttggggtttgctgtctccccagctccagccctcagggacaggggtggaatttagggctgggggtttagggcatctagcctggcctgacttcccccctccccgcttccaggggtctgttattagcagtccacgccctcaccagaggatgccacctccgcccccacccccgccgccagaggagtacaagagccagaggcccgtctccaactcctcatccttcctgggctccctatttggaagcaagcggggcaaggggcccttccagatgccaccaccgccaacaggccaggcctctgcctcctcttcatctgcttcttccacgcaccaccaccaccaccaccaccatcatggccatagccacggtggcctgggggtgctgcctgatgggcagtccaagctccaggccctgcatgcccagtattgccaaggaccgggccctgccccgccaccctacctcccaccccagcagccctctcttcccccacctccccagcagcccccacccttgccccagctgggctccattccaccgcctcccgcctcagccccacctgtggggccacatcgccacttccacgcccatggcccagtcccagggccccaacactataccttgggccggccaggcagggcacccagacggggggctggaggacaccctcagtttgctccacatggccgccaccccctgcaccagcccacatccccactgcccctgtacagtcctgccccccagcaccctccagcccacaaacagggccctaagcacttcatcttcagccaccacccacagatgatgccagcagcaggcgcggctgggggccctggatcccggccaccagggggctcctactcccacccccaccacccccagtcaccattgtcaccacactcacccatcccaccccacccctcctatccacccctccccccaccctcccctcacaccccgcactcaccccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgct

SEQ ID NO: 3419 - DNA, 135349 bp, human
atggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtgattcatgattatccatgtatcatggattaaaataaaataaagggcttgtcccccacatcctagaaattatggtcctttcctatatcctcttaggagctcactccaaacttttttttctcctgttgttttcttttctgttttaaaggggaagaaaaaaaaatctatcatggctttgtttttctttttcttttttctttttttttttttttgaggcggaatcttgatctgtcacccaggctggagtgcagtggtgcagtctcggctcactgcaacctctgccgcctcagcctcccaaatagctgggattacaggtgcacgccactacgccccgctaattttttggttttttagtagagacagggtttcaccatgttgagcaggctggtcttgaactcctgacctcaggtgatcctcccgccttggcctcccaaagtgttgggattacaggcatgagtcatggctcctggcctatcatgactttcttttggaaaaattgttttaatttgttagctttaggaaagtccccaaactcttaatgtctccttttgaaaacttttcataaatatatgacttatgagttgattgttatactaagtacttgagaatgtgatagggaaatatattcagtgtggcatataccttttctctttttctttcaataaaatcttgggggttcatgtggtgtttttcagaacaggaaaggttttacttgattctttgaggacctttactgatagaagctcatgatgcctttgagtttacctcagagagtatctctggaagaaataatcaccagaatctattgaagttattcagctagaatgtgtttagaaatgagaaatgaaagcaacaggagaatgattgaattgcctacatatttggttccataataaatgttcatgtagtacttttaattaatgaagaactaaatagggacagaacatcatagaaggggttataatgagaagttttagacagatgtgggtcaaatataaggaaaacctctgtgacctcagtcagcccataggaaatggttggttattgatcacatgggatgcttaaaattaggatggaataaagccagttgctaagaacaggtttctgttgctcaaattccagtggtctccgtgagtgtaggtgtatatgtatgaaaacaccatgatttcactcattctgaatttgctgtaggttgctgttcagataggttggaatttagtccaggtttctgcatttctaggaagctttttgtttaatgccatggtttccaaactttactgtttataagagtcagtatttgcttcatatgcaaactctagggcccgttggtacaaattctgattcaataaatctggattggggtgcaagactgcaatttttaaaaactttctaagtgcttctaatttagggagtcccttgaacactctttagaaagcaagttacttatcagtcagacccattccggtgggcctcgaaaggtatgtgcatgtgtggagtttgcttggttttcttctcacctgctttttaccctttaagaattttatatggtatacattgtagtagaaatattagataatgcaggcaagcaagcatcagaatgacctaaaattccagtactttgagtacaaggctttaaacattttagtatatacatctttctggtatatgtatgtgtgtatatatatatatatatatgcacacacacacatatatctttctataaaattttataatctttattttcacttatcttgaatctcttttcattatctgtaagtgtatatttatttatttatttttgttagtgtatatttacataattttttttctttttaaattttattttttgatttccaaattttaagttcagaggtacatgtgcaggatgtgcaggtttgttacataggtaaacgtgtgccatggtggtttgctgcataaatcatcccatcacctaggtatttagcccagcatccattagctgttcttcctgatgctctccctcctcccacccacccccattttttattttttatttattttattaattttttaattttattttttgagacagagtctcactcttttgcccaggctggagtgcagtggcatgatctcggctcattgtaacctccacctcccaggctgaagcaattctcccacttcagcctctcgagtagctgggactacaggtgtgtgccaccactcctggctaattttgtttttgtattttttttttattatactttaagttttaggatacatgtgcacaacgtgcaggtttgtttttgtatttttagtagagatgggttttgccgtgttgccctggttggtctcaaactcctgggctcaagccatctgcctgccttggcctcccacggtgctgggattacaggcgtcagccactgtgcctggcctacataatttttttaaaatagatgcctactatttcattataaggttcttctaggttatttaagcagtcccatattgttggatatgtagggccttttatttttttgggagacataatctcacgccgtcatctaggctggaatgcagtggcgctgtcttggctcactgaagccttaacgtcctgggctcaagtgatcctcccacctcagcctccctagtagctgggactgcggatgtgtgccaccacactcaggtaatagtgttttttgtttgtttgtttgtttgtttgttttagacggagtcttgctctgttgcccagggtagagtgcagtggcacaatctcggctcactgcaacctccacctcccaggttcaagtgattattctgcctcagcctccctagtagctgggactacaggtgtgtgccaccacgcctggctaatttttgtatttttagtagagataggggtttcaccatattggccaggctggtctcgaactcctgaccttgtgatctgcctgcctcggcctcccaaagtgctgggattacaggcgtgagccaccatgcctggccgtgtttttattttttgtggaaatgaagtcttactattttgcccaagctggtctcacacttctaggctcaagtgctccttccacttcggcttcccaaaatgctgggattataggcatgagccactgtagcctgccaaggtttttcctctctactattttactattataaccatggctatgatgaacatccttgtgtataatattgaaagttatgtaaattttaatttcatctctgcattgtgacatcagtagcactcaactttgcatgataccatctgtaaatgagggaaataatttccattcacttggtagtagggtacatagtaaagataagtcagtcattttgcaagctgtgtactctagttatgttaaaggatgtttaggtaaaacttgaaaatatttcagtgggagaaactgcataggatactgactttttttttttttttaagacagagtcttgctctgttgcccaggctggagtgctgtggtgcaatctcggctcactgcaacctcctgggttccagcctcctgggttcaagcgattctcttgcctcagcctcccgagtagctgggattacaggcatgtaccaccatgcccggctaatttttgtatttttagtagaggcaggtttcaacatactggccaggctggtcttgaactccggacctcaggtgatctgcccgccttggcctcccaaagtgctgggagtacaggcgtgagccaccgcacctggctgtaggatactgacttctatcattcacctctggaaaggtttaaaaatctcataaggtcttactactcgaagtgtggtccctggaccagcagcatggacatcacctgggagcttgtcagaactgcatattcccaggcctcattccagacattctgaatcagaatctgacttttggtaacacatccaagtgatttgtatgcacagttaagtagagtttgggaagcacttgaaatatgggaccaaacccaaaagctagctgaaacacagtaggcattcctttaatacactaacatgatctttatattatattatgtattctgatttccggcttccagtccagacttctcaaattggaatctttaggagatgagctccaggaacttactgtttaaaagttcccaagatgctgggcatggtggtgctcacctatagtcctagctactcagaaggttgaggcaggagagtcacttgagccccagagtttgaggctgcagtgagttgtgattgtgccccactgcactccaccctgggtgacagaatgagaccctgtctcaaaaaaaagttccctaggtgattggatacatagccagatttcagaatctctaatgtggaggaaatgtaatatataaagtacattttaatttacacagaaaacaacaattgtaattttctgttctaaaaggaatgtcagaattagtggacttatttaatcagtttttggatattgcttcgtcttctccttttttttttttaaaggcaaagtcttgctctgttgcccaggctagagtacagtggcatgatcatagctcactgtaacctcgaatgcctgggctcaggatcctcccgaatagccaggactacaggcataggccaccatccccagctaatttttttttttttgaaatattttgtagagatgccttagcctcccaaaatgctggaattacaggcatgagccaccgtgcccagcctgcatatttgaaattaagaaaaactagcttatttataatcccaggagaataaggggcatcatctttgaattacttcctgagtacaatgcagtttgtaatgtacaatttctcattcttcttctacagtcttatttattatataattaaacaagtctgtagaagaagaccccagtgagcagtttgaatgtctaaattattctagattctttttcattctttttttatatgtgtgtgcgagattgtatatataatatatatataattgatatgtccatacttttgtcttatcaatttgatatatgttctatttattaccattattaaaatatataaactatagcattgacactacctcttgcttaattttctcccctaatgttaggtaattcttttctttttttttttcttttttattttttgagacagggtctccctctgtcacccaggctggagtgcagtggtaatgatcacagctcactgtagccttgaccttgtgggcttaattgattctcccacctcagcctccctagtagctgggaccacagatgtgtgtcaccatgcctggctaatttttgtattttttgtagagacggggttttgccatgttgcccaggctggcctcaagtgatctgcccgtctcggcctcccaaagtgctgggattacaggcatgagccaccaccacctggccttttgatttttagagacagagtctcactctgtctgccagattggtcttgaagtcctgggctcaagtgatcctcctgccttggccaaccaagtagctgggactacaggcacaagccactgtacctggtacttttcttttttttaaattttatttttgcgtgtttgatttgaaatttatagctcaacaataggttttaatacctttttctcttgatggcattcccttcttccccattgtggatatttgagtcttgtgaaataattctgtttgtttgctttttgtagagacagtctcattatgttgtccaggccagtctcgaactcctggcttctagaggtcctcctgtctctgcctctcagagtgctgagattacagacatgagccaccatgcccagcctaattctgtcttttttatcaccaacaaagcaaaggcaaattgtgtaataattcttaacagccccactccatttgtttagaatacattgaccttatggtgctgcaaagaactgggagcgataaattttactgctgatatttgactttgaggatgttgaaaacaaactctcagatttaggatttggctataaacacctgcatttcaagtttttcatattttatggtttccataacttgatttttttaagagacaaggtcttgctctgttgcccaggctggaatgcaatggcatgttgtagctcactgcaacctcaaactcctatgctccatcagtcttccccgctcagacttcctagtggcatgatctcggctcactgcaacctctgcctcctgggttcaagcaattcttctgtctcagcctcccgagtagctgggactacaggcgcttgccaccacacctagctaattttttgtatttttagtagagacggggtttcactgtgttagccaggatggtctcgatctcctgacctcaagtgatctgcctgcctcagtctcccaaagtacaggattacaggtgtgagccactgcacccggctataatttctttcattttaattttattatttttttttagaggcagggtctcactatgttgcttgggctggtctcaaactcctgggctcaagtgattctcctgccttggcctctcaaagttctggaattacaggcatgagccactgcacccagtctttaatttttgtagagatggggttttgctatgttgctcaggctagtcttgaactcctgggttcaagtgatcctcctaccttggcctccaaaaacactgggattacaggcatgagccactgtacctggctcccataactttatttaaaaaatatattaatggggcctggtgcggtggctcacgcctgtaatcccagcactttggaaggccgaggcaggcggatcacgaggtcaggagattgagaccatcctggctaacacagtgaaatctcgtctctactaaaaatacaaaaaattagccgggtgtagtggcgggcatctgtagtcccagctactcgggaggctgaggcaggagaatggcgtgaacccaggaggcggagcttacagtgagctgagatcacgctactgcactccagcctgggcaacagagcgagacttcatctcaaaaaaaaaaaaaaatcaaacaaacaaacaaaaattaatggaaagactttgacctattgttctttgtaaaaactttggtaaattacttggtgattacttggtaaattagtaaattactgtgagtgagggctataagtcgtaagtgctatttagaagactatattttagtttatgatgttgaaagacttggtcacatgttactgaaagaccagtttagcaactctcagaaagaatcagtcacaggagtttgtaatagtttcttcctccactaacaatttgaaaattaacatcacttagcttttacacatggaaatacaaccagtttttgctctatgatgagttggaaaatacttacaccagtacatttatcatttgttttcttcatataatggaactatttcctttttttttttttttttttttttttttgagagggagtttcgctcttgttgcccaggctggagtgcaatggcatgatcttggctcactgcaacctccgcctcccgggttcaagcgattctcctgtctcagcctcctgagttgctgggattacaggcatgtgctaccatgcccagctaatttttgtgtttttagtagagactgggtttcaccattttggccaggctagtcttgaactcctgacttcaagtgatccacccgtctcggccttccaaagtgctgggattacagtcgtgagccacaacgcccggccaatggaacttttttctaaatatagaaacatcatagagatttgaaatatgttttgttgactttttctgaaatgtatttgagtgtgcttgtaataagcctcactctgtggtcagatatgtgattgtgtactttggagggtaacagacctttgaatagcacttagatatctaacaactcgagctatagcctgttaaccgaaccaaacatgacactgaaaagaaataccaaaaggaaaaaaatggcacaatagagtatagcaggttgacacgttgagtgagcattctaatatactttcattatagtaatgaatatactcaaagcaatgcagtggaagtaacagcttaaaaatccatacttccacacctgaagcatctatcaaaattgtggaagaacttatttctattttattttcattcatcatctaagtatactttggggaaaactatattttgagacattagccctattacatttgattgtgaaattagaattagatacgaaaacagttgaatttccaataaaggaaaaagtaatttaaaaagatgctagaatttctgtttctgaatatagttgtttacagtattcgcactgggacatttaattttgctccccaaatatttttatgtccctcttggaaatgtttctggattctgtttagccgtgtaagaaagtgcttcattacattataggcacacgccaaatagtctgattcagtttgatttcccactctcttcatcagatccagccctaaaagtagaattcagtcatggacaaagcgtgattacattgaagggaggagggatagagcttgcttaaatatacatgttctcatctctgtttaaaaactagtcacgaactttattaaatataaaccaaaggcaaatgcttttacaaaatgacaaagggtgggagtggcaggagatagcctttgtctgggaaatagcattaatttccccagttagttgagtgagttagttttgagctaattatttgcttgatagatttaaaaaattgatacatgtggtaagctgaaaatagccccccaaagatgtccatgtcctaatccctggaacctgtgaatatgtcatcttacatttcaaaaaggactttgcagatgcgattaacttaaagatctagggattggaagattaccctggattatctgggtggacccagtgtaatcacaagggtccttataagagggaggcagaatggccatagtcagaggaggagatctgatgatggaagcagaggctggagtgatgcagttgctgacaatgagccaacgaatgtggacagtctccagaagctggaaaagataaggaaacattcttctctagagtcttcacaggaatgcagccctcctgataccttgattttagtctagagagactcaatttggatttcttaatccctacaactagcagataatacatttctgttttaagccactgtgtttgttgtaatttgttacagtagcaataggaaatgaatacaatagactatagctgccatttgttcattcaacaaataaatagtacctgcaatgtgccagacacatgccaagtgctagggacataatggggagaaaaagcagacacaggcctcattttcacaaagcttacagtagaaggagtttacagttataagaaggcttagaaattggagttcgtgaaatgatgaaagggctgtttaatataggtttgtttaaaggaaatggtagggttgacagtagggggcaacagggataccactcctttattacatagttttcttttttaaaaactttttattttgatatattttctactcacagaagagttgcaaaaagagtatagaaagttcctgtatacccatcacccagactccctttatgttaatatcttgtatttttatttttggtagagatggggtcttgctatgctgaacaggctgatctctaactcctggcctcaagcattcctcctgcctcggcctcccaaagtgctgggattacaggtgtgagccaccatgcttggcccttagttgttttttagattgccccttagttgttttttagattgccccttaatttgactttgtcttatgttttctcatgcttagatttagactatgcatttttggcaggaataccacagaagtgatgcaccatcctcagtgcatcataactgggggtacatggtgttgttttgtattactggtgataataatcttgatcacttggttaaggtggtatctgccaggctttctctcctgtaaagttactgtttttcctgttgtatattagtaaatatcttgggggtagatctttgagactatgcaaatatactgttttcttttaaacttttgcccgctgattttagcatccgttggtgtatcttgcatgtcatcattataactgtagtgttctaatgatttttttctcacattccttctgcatttattaattggcattaacctgttagttttatgtgatttctccccagtatacctgttaagtttctggaaacccaacaataggagaatttatggttgagatactttggtatagttagtaatagcaggtatcatatattttccattatcaaaattaacattaatggaacatttatactggtacttaatttgaatattttatttaatccttagaataggtatatgagataaggattattagttttcagatggtggaactgaaatttagatatgttaagcaattttcccaatggagcagagtcaggatttgtattccatcaattatatctatgtaaagcatttacatagatgattgaagaatttcccactcactagttacttgggcagatcattcttttatgtttttaaccattttagaacaaatgatttcttaaacggatcctgtttaagattcttaacattgaactaccgaaactcaagggatgtcagttaatggtgtcattgaagggcacctgaggaatagtttcgtgattagatggtcatggttcagtatctggccttcaccttttgtcaatgtccagaggttggggagttggggagactgacttgtgttcactccagctcctaaatctaggatacaagtttattattttaaaatgagaaatatagttgttaggtaaaatgttctatatagtctttaggctagttacatggggagctaaattataatcagaagctggcttggtgcttatagagtcggaacaaaggagctagatgttcctgtatgtcctcctgctaaggcaagagcctgaccaaatgaaccgaatgctcacattctgattggatgaggacatctttgatcagcagttctggaagataagtgaacctggttctatgcatggtttattgccttttgatttattaccttgactaccacttgtgagcacttttcttttttctttctttttttttttttttgggatggagtcttgctctgtcactcaggctggagtgcgatggcgtgatctcggctcactgcaacctctgcctccggggtcaagcgaattttctgcctcccgggtcaagcgaatttcctgcctcagcctctcgagtagctgggattataggcatgcgctaccacgcccagctaatttttgtatttttagtagagatggggtttcaccatgttggccaggctggtctcgaactcctgacctcaggtgatccacccgcctcagcctcccaaagtgttgggattacaggtgtgagccaccgcgctcagccaagcacttttctttaggtattaataccattgctgtctcaaagctttagtatggtaatatgaccagattatgactattataccgtgatttcttaattgatatgttgatgtcaccttttacaaattatcgttatcctcagtgtctgtttatttcatttagcatgagttctggggtactacaccatctctccatggaaagtggtttgtgaatgagatatctgcactcattgccatgactgctgtttctgagaggcagagtagtgaaccagaaagtgctttggattcagaattcagcgtacggggttccagtgttgcctgtgccagttaggtaccttgggtaagccagatagtttaactggagccttaattttttacttttcttttaaagaaaaacatgataaatactttggatgtactaaaaagaataaagagtaacataatggaaactgtgtacctactgcccagtttaagaaataaaacattggctgggggcggtagctcacgcctgtaatcccagcactgtgggaggctgaggtgggtggatcacctgaggtcagacattcgagatcagcctggccaacatggcgaaactcctcctctactaaaaataccaaaattagcggcgcatggtggcgcatgcctgtaatcccagctactcagaaggctgaggcaggagaattgcttgaacccgggaggtggaggttgcggtgagcccagatcatgccattgcactccagcctgggtgacagagcaagactccatctcaaaaaaaaaagaaaagaaaacattgaggattagagagattacttttaaagcatgtgacgcattttagtgttcaataaatggtagtgttaaaatactgagcaacctcatgtttatcaagaatattcaagctgaggcaggagaatagcttgaggataggaattcaagaccagcctggtcaacatagcaagggctcatctccacagaaagaaaaaaaaaaaaagctgagcataggcatagtggcatgtcccagtagtgtcttgggtatttgggagactgaggcaagaggatcatgtgagcccaggagttcaaggctgcagtgaactatgatcgtgccactgcactccagcctgggcaacacagagtgagaccctgtctctctaaaaagaaaaaaaatattcattgatagagtgctttataagctaagcatcattttgaagcctttgtaatattcatccttacttgattaggttattttataatatagcttttatatcattgttaatgatttctcctttcacatttgcggaaacagatccatgtagcctctgacttgtttctgtagatcattgttggtgtttgcattaagatatatacctgataaggacatagtttactttttggaaatgaaatgcttcttatcttgaataaatatatatacaggttggtcatactggtattgtgccatgtctcaggaaaggttttgtgtacacttttagcattccatatgttataatagatttaatgtttagttaacatttataaaaggataatatttctttttacagtagtgtggagtagttgaaatctatttgataaatttgtatttgactcctatttatcagctatataaatgaacatttataacactgatatttgacataaaattgatatttgatgctttcttcttggtgtccttaccttgagacagcaagatttagggatcattttcatagaccagaattttcccagcatttgactatgtcagcttcattagctagtgctgttctctggtttgtcttttgtggctcatcattcctttcttgtgtaagaattcttattgatgatgtgtgaaagtttctctaccaaagtggttgtcattaatacaataatgcatgtaggggtgtgtgtgtttaaaggatgttactgtggtagctgaaagctctactctaagtattttcctctggattttggtgctactttaacaggtttactttccccttgctaaatgtgaagtggagttttgaagatcttggctctacatttttagtagacttcacctccagcagtatatctgggaaaacagttgtaattttgtaaagttgtttattcctaatgctgactactttcaatctgtagaatcaaaggatgaagtagggtagtttagtatggcacatgaaagacttggcattctactaatttaatcagaaggcatcaaaatttattcattattctggccaggtatggtgactcatgcctataatcctagcactttgggaggctgaggcaggcagatcacttgagctcaggagtttgagaccagcctgggcaacatggcgaaatcccatctttacaaaaaatacaaaaatcagctgggtgtggtggcatgtgcctgtagtcccagctacttggtaggctgaggtgggaggatcgcttgaacctgggaggtggaagttgcagtgagctgagatcgcgccactgcactccagcctgagtgacagagtgacaccctgtctcaaaaaagaattactaattattcttcagagtagatctgctgtctatcatgagtagaggacttctagccagttataggggcacttaagacttattagtcaggttgggctgggtgcagtggctcatacctgtaatcccagcactttgggaggccgaggtgggcggatcgcctgaggtcaggagttcaaaaccagcctggccaacatggcgaaaccctttctctactaaaaatacaaaaattagtcaggcgtgatggcgggcacctgtaatcccagctactgggggaggctgaggcacgagaatcgcttgatcccgggaagtggaggttgcagtgaaccgaggtcacactactcactccagcctggatgacagagcaagactccatctcaaaaaaaaaagaaaagacttattaggccagatagtaaagcataaagactctacttgtttccttgcttttgttctctgagttccttattttttttcaagacagggtcttgctctcttacctaggctggagtgcagtggcgtgaccatagttcactgcagccttgaacgcctgggctcaagtgatcctcctgcctcagcctcccaagtagctaggactacaggtgcatgcctccatgcccagctattttgtatagttggggtcttgttttgttgcccaagctggtcttgaactccttcctagcctccctaagtactgggattacagatgtgaaccactgtgcctgctgacttccttaactttctaaaaaatattttttattgtggcaaaatgtctaatatataacaagagttaccatcttaaccttttttttttttttgagacagagtctcactctgttgtccaggctggagtgaagtggcatgatatcagctcactgcaacccctgcctcctgggttcaagcaattctcatgcctcagcctcccgagttgctgggatcacaggcgcgtgccaccacagccggataatttttgtatttttagtagagaatggggttttgccatgttggctgggctggtctcgaactcctggcctcaggttatctgcccgtcttgacctcccaaagtgctgggattacaggcgtgagccactgtgcccagccatcttaaccatttttaagtgtgcagtttttcagtggcattaagtatatttacatcattgtacatccctcagcaatatccatctccagtacttttttatcattccaaatagaaactctatactcattaaacaatttaacttcccctggctgggcgcggtggctcacgcctataatcccagcactttgggaggccgaggcaggtggatcacgaggtcagaagatcgagaccatcctggctaacatggtgaaaccctgtctctactaaaaaatacaaaaaatttgccgggcatggtggcacgtgcctgtagtcccagctacttgggaggctgaggcaggagaatggcgtgaacccgggaggcggagcttacagtgagctgagatggcaccaccgcactccagcctgggcgacagagcgagattccgtctcaaaaaaaaaagaaaaaaaaaatttaacttcccattccccactctgcctagctcctgttaactactattctactttctgtctctatgaatgtgcctattgtaggtacctcatataagtggaatcaagcaatgtttgtctttcctgtctcgtttatttcacttaccataacgttttcaaaattcatccatgttggccgggtgcggtggctcacacctgtaatcccagctactttgggaggccgaggtgggcggatcacaaggtcaagagttcgagaccagcctggccaacatggtgaaaccccgtccctactaagaatacaaaaattagctgggcatggtggcatgtgcctgtaatcctagctactcaggaggctgaggcaggagaattgcttgaacccggcaggcggaggttgcagtgagccgagattgtgcctctgtactccagactgggtgatagagcaagactccatctcaggaaaaaaaaaaaaaaaagattcatccatgttttgtagcatgtatcagaatttcatttctctttaaggctaaacagtattccattgtatgtatgtaccatattttgtttattcatctgttggtgggcatttgagttgtttctacgttttggctattgtgaataatgctgctatgaacatggttctacaaatgtctgtgtctctgctttcaattcttttgggtatatacctagaatacctaaaagtagaattgctggagcatatgataattctatgtttaatatgttgaggaaccatcatgttgctttccacaacgaatataccattttacattccccagcaatgtacaaggtttctccatatccttgccaacacttcttatttatttatttatatatttatttacttagataatagccatcctaatgggtgtgaagtggtattttattgtggttttgatttgcattgccctgacaactaatgatgttgagcatcttttctcaaagttgtagagattataagtcccagatcaagttctagcttggtgggtttctggtgagggctctcttcatggcttggtgaggagagttgggagtgagctttctcttgtcttcttgtctttttttttttttttttttgagatggagtctcgctctattgcccaggctggagtgcggtggcgtgatctcagctcactgcaacctccgcctcctgggttcaagcgattctcctgcctcaacctcccaagtagctgggattacaggtgcctgccaccacgcctggctacttctttatatttttagtagagacggggttccaacatgttggacaggctggtcttgatctcctgacctcaggtgatccacccatcttggcctcccaaagtgctggggttacgggcatgagccactgcacccggcctctgttatctctttttataaggatactaatcctattggatcaaggacccacccttatgacataaaggtcccgtctccaaatacagtcacattggggttggggttttaacttacaaattttggcggaggagagaggacacaaacattccatctataatacaggggaagatctgctgatctctttgtatagttatgccccctcaaaagtgtgagcagagctaaaagactagtgggctgaccagtcttttagtcttgagggtctaaagggtagacggggtcatttttagtctgcagagtaggagagagagttagcttttgcattctaggagaataaggagcaaacacacttcctcgatgtctaacaagatgttagttgttacagaacagccctcaggggagagactgctatagctccatcactcatgggactacataaggtaccccagggctcccctgagtaaatcaaggactcagaagaggattgaatatgaggggaaaataatcacttttctgacttgaattagtagtctcgataatcaaaaagaagtagtatctaaaagtagatatctagtaaaatctggtaaataactagactaaccaagaaaaaagaatcttacatgcacctttcttcttatcttcaatgctagaagctaaaagacagtagaccattaaggggaaaaggctacaccatccaagaatctctaatcaactaagatatcatctcccagggtgaaaaagatattcatggaccatagtgcagaaaactatgtaatagttgaaaagatgaagctagatctatgtaactaacatatgttgacattgaatgaatggaatatttgataaaagtgctaagtaaagactctacagctagaacagaagtgtgtcagggggaggggcaatcatatagaagtggacagtgtaggggtgattaagtcttttttttttttttttttttgagacaaggtctccctctgttgcccaggctggagtgcagtagcagaatcttggcttgctgcaacctccacctcccaggctcaagtgatcctcccacctcagcctcccaagtagctaggactacagctattgggacgtgcctccatgctcagctgattttttttatttttagtagagacaaggttttgccatgttgtccaggctgatttcgaactcctgagctcgaacgattcacctgcctcagcctcccaaagtactgatattacaggcatgagccatcgtgcctgaccagtgattaagtcttctacatgtgttgtctatgtggcatgatagaaaggggggaaatattagtattttagattatttatttatttttggtgaatgggggctaggtgaagtagggagaacgagtagatgagttactttcttaaaacagataaatatgtttgatcttgagtgtctggaaagggaggctatccactagtaaaaaaggaaaaatattatatatctctttgttttttgagacagcatctcactttgtcactcaggctagagtgcagtgtggcgcagtgtggcgcaaacatggctcactatacagtctcgacctcccgggttcaagcgatcctccagcctcagccccctaagtagctgggactacagacatacaccactatgcccggctaatttttgtattttttgtagagacagggttttgtcatgttgctcaggctggtcttaaactcctgagcctaagcaatgcacccaccttgacctcccaaattgttgggattacagatgtgagccactgtgcctagcctgctacatctcttagttaataatagaaaacaacaaagtgaaataaataaagaacataaaataagattgaaggagtaaaattaagtatattatttgctataccaaatgtggacatgttgcatttacttaataagaaactcagattgtcaggtagagttaaaagacaaaactcacatgtgttgtttactaaaatcatacttaaagcagtgataaagaaaaggtaaaggtgtaaacaagcaaagagaaaacaagagtggcaatgtgttttgttttttttttttttgtttttttttttgagacagagtctcactctgtcgcccaggctggagtgcagtggcatgctcttggctcactgcaacctctgcctcttgggctcaagtgattctcatgtctcagcctcccaagtagctgggattacacgcacgtgccaccacacctggctaattttttgtgtttttattagagacagggtttcaccatgtcgactaggctggtctcgagctcctgacctcaggcgatctgcccgccttggcctcccaaagtgctgggattacaggtgtaagccaccacacctggccccaaagtggcaatgttaatgtacatcaaaaaaggaggaaaacaaggttgaaacattagacaggatattatgaaattatatacttcatagtttacgaagatgtatcaaaaacttgtagacatcaacaacattttggctaaataacctctaatagcattttcaaaaaagcaaacatgtatttgtagtgggaaatttcatgtacatttctttcagcataggagagatctagtgcacaaaaagtgagtaaatacagaggagttgtgccaggcgaggtggctcacgcctgtaatcccagcactttgggaggccgaggcaggtggatcacctgaggtcaggagttcaagatcatcctgaccaacatggagaaaccccacctctactaaaaatacaaaattagccggggtggtggcgcatgcctgtaatcacagctactcgggaggctgaggcaggagaattgcttgaacccgggagacggaggttgccgtgagccaagatcgcgccattgcactccagcctgggcaacaagagcaaaactctatctcaaaaaaaaaaaaaatacagaggagttgaataatataatccacaatccacaaactttatttgatggatgtatagaactttatatccttcaagcaagaaatatacattgttatatgtggcccccaaaaacccttaagttaaagcagagagattttgtacttgcattactcaataagattagaaataaataatgaaataaataaccaaaagattcttaactaattagagagcagaaatcacattcctaggtaaattttgaatcaaagagaaactgaaaactgaaaatgaaaatgaaaatgaaaattataaactagaaagcaatgaaaaagagaagacattacaacaaaacctgtgggtcattgcaaaagttgtacctgttagaaaatttatagcctaaaatatcttcattattaatgaacaataactaaaggaatttagtactcatgttaagaaattaggaaaataacagcaaaagaaaggaagagggaattcagaaaaactgaaattaatttaaaatttatatacataaaaataggataaatagattttattattttgggctttctgaaaaacgattaatgtacctgatgaagaaaatagggcagaaatacacaaggaaaggaatgagaaggccgggcgcaatagctcactcctgtagtcccagcactttgggaggaggccgaggcaagtggatcacttcaggtcaagagttcaagaccagcctggtcaacatggtgaaaccccatctctactaaaaatacaaaaattagccgggcgtggtggtgggcacctgtaatcccagctactcaagaggctgaggcaggagaatcacttgaccccgggaagcagaggttgcagtaagctgagatcgcaccactgcactccagcctgggcaatggagcgagactccgtctagaaaaaaaaggaatgagaaataaaacatagcatgctatgaaagagaataaaagaaattagaagataatgtcatgtacaactttgataacaaaatttttctaacattttgttattttaatttaatttttttgagacagggtctcactccgtcaccaaggttggagtgcagtggcatgatcttggctcactgcaacctctgcctcccaggttcaagcaatcctcccaccttaccctctcgagtagttagggactataaacatgcaccaccacacccagctgttgtttttattattatttttttgtagagacgggggtctcactatgttagccatgctggtctcgaactgggctcaggtgctcctcccacctcagcctcccaaagtgctaggattataggtgtgagccaccgtgcccagcccataccttccttttctaactttttgtgtccaaatttttattgaagttctttgagtaatatggtcagagacggtgtatggggtggtgtactgtctgtgtccctgttgtctagaaatgtaggattttttcacttttaaacttgatggatagcttgtctgggatcagaattttagggccatagttctccctcagaattctgtaaaattgttcctttgacttctagcagttaatgtagcagattagaggtccaatgcctatttgaatgtctcactggttcataaactaatatttctgtatggaaacctagagcacttttattttggcaattcagaaatttaattagattaaatgtctagatgtttaacatttttattgttcttgttctgacattacagatgttttagatatggaaactcagggatttcttagggaaactttcctatctgctttattgctttttctcaattcattttgagatactgtttttcaagatactgatttattacccaggtgggtttataatgtacttatgaaatataatagtgctgcattgccatgttggaggagtcacagtagctaataaaggatatctgtgatgatacaagtcttgagaaaagcattgacaggcaaaaataaataaatatacacatccatgcatatatgcaataaagcattcagttgagtggtattagaaatgtgcatgagaattttcatgactttattttggaacttgttattccttttcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtaagttgaccctgatagtgccaatgtagttttatttggaaataattttcaggagtcataacaatttttataaaataaaactactcaaagaatttttagaatctggccaggcgcagtggctacacctgtaatcccagcactttgggagactgaggagggtggatctcaagactagcctgggcaacatggtgaaaccttgtctctaccaaaaaaatacaaaaagtaaccagatgtggcagcacacacctgtagtcccagctactcaggaggctgaggttggaggatggcttgagcctgggagatggaggttgcagtgagccatgattgtgccactgtattccagcctggttgacaaagccagatcctgtctcaaaaaaaaaaagaatttgtagattcgaatctagtgactgttttaagttaggttaaacaattgagatgttaatgaagtttgttaaaaaaatacagtactgagaagttaatgtttgtgggatattatagaattttagaattaaaaatctattatagagaatataattttattttattttattttattttattattttttgggacagggtctcactctgtcacccagactggagtggtgcagtggcatgatcatggctaactgcagcttcgacctccttgggctcaagtgaccctcccacctcagcctactgagtagctggaaccacaagcatgcagcaacatgcctggctaatttttttaaaaataatttttgtagagatggggtttcgccgtgttgcccaggctggtctcgaattcctgggctaaagcaatctgcccacctcagcctcccaaagtgctagggttataggagtgaggcagcatgcccggccataattttattttgtagaagataatggaaggttggagggcttggtcaagttcaaatatctagtgagcgatactattatgatattatagtattatagtatattattatagtattatatagtataatattatagtattatagactattaattatagtcttttatttctaaccacaattattcatttggtgaataatgacttgtaaatattaaatgtggtttaatcacttgcaaatattaaatatggtataaactttttgtttcctaacatttgtgtatatactaaaattttacatagtttaaccctctagtgactttatataagcagttattaggtagtagagaaggactttctttttaaaattgtgctgccattctacaaaaggccactctggaatgatttttagtttgaattaaaaatgctacacttggctaagtgtggtggctgatgcctgtcatcctagcactttgggaggccgaggcaggcagatcacctgaggtcaggatttcaagaccagcctggcccacatggtgaaaccccgtctatgccaaaatgcaaaaattagcttggcgtggtggtgcatgcctgtagtcccagttacttgggaggctgaggcatgagaatcacatgaacctgggaggcggaagctgcagtgagctgagattgcaccactgccctccagcctgggagacagagtgagacttcgtcttaaaaaaaaaccaaccaaccaaccaaacaaacaaaacagctatgcttggtaggatgtcttatctaagaatgaagtattagattaaatttttgttttgccataacagacaatagaaaacaactcagtgatgggaatcatagtgcataagttgtttgcttatgtaacttaccttaatagtgttcatataataagttggatatgtttgtttacacatggtcttttgtttctttgtataggtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggtgattaaagttttacagtttactggttgggtaaagagagatttttcaattgtataggtctagaacaggaatcagccagctatggccagtgggatgaatgtggctcactgcctgtttttgtaaatcgaattttattagaacacagtcacactcactcatttacagattgtctaggactgcttttgcacctacaagtgacagagttgagtagttgtgtgacagagaccatacaaactgcaaaacctaaacagtttactatctggcccttaacagaaaagtttgccaatactgggcttagactgaatttgctttgaaatacctattatatattggcttttttcagagacatcctaatgtattttttgtgggataataatttatatttaggattattgaaaggttctaaggatgtaagtaagagagtttattaagttaattcagaaaaatttaagtaaaaaggatagaaataaaaacattttattaatcgttacctaatcttgagcattacaaattacactctatcagtatggaaaattaaataaattatttcagtgctttatgtagatatagcaaatattcaacaaattgtatacttaaaaatttgcggccaggcatggtggcccacgcctgtaatcccagcactttgggagcctgaggcgggtggatcacgaggtcaggagttcgagaccagcctggccaacatggtgaaaccccgtctctactaaaaatacaaaaattagccaggcatggtggcaggcgcttgtaatcccagctacccgggaggctgaggcaggagaatcacttgaacccgggtggcagaggttgcagtgagctgagatggcaccactgcactccagcctgggcaacagagcaagactatgtctcaaaaaaaaaaaagaaatttgctttgggggagtagaaattaacacagataatccttataggaaaggggatgtgatcttggtggatacgtttttctcttctataagaatgtggtggtggtgttattttgtaggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtgtaggtataacttttttctttttactttatcagttgccacgtttcatgttgaaattagttaagtttgacttactcaaaactaattttggtttagctctaggtaacagtattaaaattaacaattgtaatgcaacaagccttagatttataccatatgactatgcttcattggagtcatataaaatgctctgtattagtatctttgggaaaatgtacaggtatatcatctatatatatttgtttgtaaggaatttttagttatctattagatggatcttatttttcaaagctgaataatagagaccgactacatggtttcttctaggtctaaaagcctttttatgaaagggcattcaaaatatagttcaatagatacagtatttgggtccctgctatgagtaaatttttgtgttagaaattgtaaggaatgcaaacatgagtaagaagtgtttgctaccctaaagagcttacatttctaataagggaataatataaattcacaaatgactataaaataagaggatgagagtatagtaagggacataaggaaggtagaagcaaagtgttgttcaaaggaggactgcttcatatccagttgggcagctcaagacaggctgtgaaagattgtttcaggtagcttaacattagtaggtattggttttttaaatccttttaaaattaataccttttttttttttttttgagacacagtctgtcgccaggctttagtgcagtggcgggatctcggctcactgcaacctccacctcccgggttcaagcaattctcctgcctcagcctcccaaatagctgggactacaggtgtgcaccaccacgcccagctaattttgtatttttagtagagatggggtttcaccatgttggccaggatggtcttgatctcttgaccttgtgattcgcccacctcggcctcccaaagtgctgggattacaggtgtgagccaccgcgcctggccaaaattaatatcatttttaattgacaaattgttattgtacatatttaaggggtaccatgtgatgttttgagatacacacacacaaatgtggaatgattaaatcaggctagttaacatatctgtcaccccacttgcttattattttgtgtggtaagacatttgaaatttactaagttattttgaaatttacagtatattattgttattatcgactgtagttaccctggtgtacggtagatctcaaaacctactcctcctgtctaactgcaacttgtaccttttgaccaatagctccccatttcctcccccacaactcccagtctctggtaaccatcattctactcttctatgaggtcatcttttttagattccatgtgtaagtgagatcatgttgtatttgtctttctgtgctggtttatttcacttaacataatgtcttctaggttcatccacattgtcacaaatgatagaattttcttctttttaaaggctgaatagtattccattgtatatatataccacattttctttattcattcactgatgaacatgtaggtcatttccatatcttggctattgtgtatagtgatgcagtgaacataggcatgcatatatctgtttgacatactaatttcaattcctttgggtatgtaccaagaagtagaattgctatggtagttctgtttttagtttttttggggaagttccataccattttccataacagctgtaccatttatattcccatcaacaacgtacaagggttcccttttctctgcatcctcaccaacacttatctttcatcttttcgataatagtcattctaacagatgtgaggagatactgttttttaatgcatgcggtataccacatgctttatttatttattttttgagaccgagtcttgccctgtcgtctaggctggagtgcaatggcgctatctcggctcactgcatcctccacctcccaggttcaggtgattctcctgcctcagcctcccgagtagctgggattacaggcgtgcaccaccatgcccggctaattttttgtatctttagtagagatggtgtttcaccatgttggccaggatggtcttgaactcctgacctcgtgatctacccaccttggcctcccaaagttctgggatcacaagcgtgagccactgcgcccggccaccacatactttaatctttatcccctacgagataggtgcaatcttcagtttacagatgatgaaactgagaatcagaggttgtaccttgcccaacttcccgcagctactgataatggtgggttttgaccccaagtctgtctgactctagaagtttgtgtaaggagacaataagaaataaggctacaatccagaatgtgggacattctgtaggacaaatgacctagtttctccaacaaatacattttatgaaacaaacaggaagggagggaggcttttatagaatacaagagacttaagagtagtggtgagctggtaaatgtttaacacctgattctctgaagaaagaaagaatgctgacttctagtatttgctgatttttgtggtataagtactcccactatggctgatttcaggttaccaatgtgacctcactgaatgaagagttgggaagagatgcactgttgcactcattgtatggttatttctaccatgcagatagagtagctgtaaataacctcaaacacataaataatagtaaactgtagtaaaatagttagggagtgatgttttcagtatttattgctttggcttttttttgctctgttttgttttgttttgtttttgagacagagtctcactctgtcacccaggctggagtgcagtggtacgatctcagctcactgcaacctctgcctcctgggttcaagcgattctcatgtttcagcctcccaagtagctgggattacgggcatgcgcctccacacctggctagtttttgtatatatatatatatttttttaataaagatgtggttttgctatgctggccaggctggtctcaaactcctgacctcgggtgatctgcccacctcggcctcccaaagtactgggattacaggtgtgggccactgtgcccagcttaccttggcttttaatgtaatttatttaattgtaaacttttataatttagttttattttaaatggccatgtttaacaattggattgcagaatttctgaaaacttaatagcatttgtgagctggtatgagccagctcatgcacaccctaccctatggaccttgtttggatcctgatttgaacaaaccaactgtaaaaagacatcatttagacaattttgaaaatttgagtatggactgggtttcagatatttgatattaaggaattattcatgagtattttaggggggacgattatatgatttttttttttttttggagacagtgtttgctctgtcacccaggcttgagtacagtggtacgatcttggctcactatagccttgacttcctgggctcaggcaatcctctcacctcagccaccctggtagctgggaccacaggtacacaccaccacacgcagctattttttttttctttttatatttttgtgtagagatggggtttcaccatgttgcccagactggtcttgaactactgggctcacgcaatccacccaccttggcctcttaaagtactaggattacaggcatgagccaccatgcctgagctacacgatttttttttaaaaggttcttatctgttagagatgtaaactggaaaattcatgggtgaaatgacgtgatgcctgagatttgctttaaaatattccaggatacaatatgtgtgggggcagatagctgaaacaaggttggcaaaatgttgactgttgttgaaactggtgatggttacacgggacttcattatgctattctactttcaagtatgtttgaaaatttctataagagctcagaaaaagagataaggctagaatgtgtttttagttttggcccatattttggaaggccataaatagaaaagaatttcgtgttagattttgtaagttacagctcctgaactgtttttacgtaggagcagagaaaggcagtaatttacccagagatgagaaatgagtatatcagtgggaaggtcaaagagggctttttccataggtagaataacaggtcaatttttaaaaattttttaaatgtatttattttagaaaatttatttttatttttaattttttattgtactttgagttgctgttttaataggtctattttttgaatagtgactttattattttatagtaaagtcattaaaaatgccatatcacaattcagatttccatctgtcttaagcttctacattttaggaactaaattaactcctaatttcatcatatttgtctacgatgtaatgctgggctttctgattctatgtcttttgaggtagcatgacaggcgtagaagtagatgttagattgcttcattccataacaattattctttccattgtacctttctgcttccagcttaatttggaattttctattaaatgactgcaatgatcttacttgggttattttttaaatcttaaataaaaggtaatagaatataaaataagcagattcaggaagccaacacagttattatagaaacattttgaattgtctggacttcatttatttgttcttgaattcctagaacctgataattagcttgaggtacatgctctcaatattttattattgtttaaggataaaaataatacagatttcttaaatatataggtatatatgttcatatatatacatatatacccatacatacacatatgtatctactgattgccgtctaccgatggcttctagccattctagaagactgaaatatagtgaattgggctgggtgcagtggctcatgcctgtaatcctagcactttgggaagctgaggcaggaggactgtttgagcccaggaattcaagaccagactgggcaacatagcaagaccttgtctctacaaaaaaaaaaaaaaaaaaaaaattagccgagtttggtggcatgcgcctgtagtcccagctactctggaggctgaggtgggaagatcacttgagcttgggaggttgaggctgcagtgagctgtgatcatgccactgcacttcagcctgggtggacagagtgagaccctgtcttaaaaataaaaaaaaaaaaaaaaatatatatatatatatatatatatatagagagagagagagagagagagagagagagagaattggaatgtttgaaatagagaagcctttattttgaattttcaaaagttttttaaaatagcattaattattttctgatttcaaaaaagtatttgtttatggctgggcgcagtggcttacgcctgtaatcccagcactttgggaggctaaggcaggcagattgcctgagatcaggagtttgagaccagtcaggccaacatggtgaaaccccgtctctactaaaaatacagaaaaattagccgggcttggtggcgtgcgcctgtaatcccagctactcaggaggctgaggcaggggaattgcttgaaccagggaggtgggaggttgcagtgagccaaaatcacgccactgcactccagcctgggcgacagagcgagactccatctcaaaataaataaataaataaacttgtttattatatattgttaattgggattatactgtatgtagatttggggatcctatttttccctacttaatagtacattatgagaatttcccatgtcattaattattctgagaacatttttaatttctgtatattgtcatatatacctgcagatctagatttgaaaatcatactatatatataacataatatgtgtaactttgcctctgttgtcagaagtttagattatttaaggtttttttactgttatttgtagacaacatccttgtcaaaaggttattaaacttatgttctctatatatacacatgtatatttaaatatttcatttaaaacttgactatggtttagtgataaaaataatgtttaataaatgtcatgttgacttgggctttcaattgcatcattgttactagaaaccatttttttctcctagggcataaaaccagccagcttcaataaagtcactgatcctgaagtcaaagaaatcattgaaggatgtattcgtcaaaacaaatctgaaaggtgggtgcaattgtagcaaaatgacataactgaaagatgcatttttctcttatcttgcattgggtcgttttctgacctttcagtcatgctgagtttgacttttgagtagaagccaaaccatactctagattgaagtgtatcagtgcatgttgtttaccattttagacttggatatcatgtgctgaatttttcttgaactgacgtttgggttgcgtttgtgtgtgtgtgtgccttttgacaagctttcatcaccttcagccatcagcttaacagtcagtaggccctcacaagttaatttgcttctaacagttgagagtggacaaaattttaaaaatttgattctatatctttagtgtcatgataatgataaagctaatatggatagaagaaatatgtattcaagaaatcgtattccacatttatttgtgtcacaatttgctttatagacaactcccattactcttagcttttgcctccctttaggttttatttcttattttatttttaattttttttttttttttttttgagacagagtctcgctctgttacccaggctgaagtgcagtggtacgatcttgacccattgcaacctctgcctcccgggttccagcgattctcctgcctcagcctcctgagtagctgggattgcaggtgcatgccatcacacctggctaatttttgtatttttagtagagacagggttttaccatgttggccaggctggtctccaactcctggcctcaagtgatccacccgtctcagcctcccaaagtgctgtcattacaggcgtgaaccaccacgcccaacctgcctccctttagtttcagctttggacagttgctgactttaaattggtgggtttgtcttttgatttttacttccttattgatgattattagtaaaggcgatatatccttagtagaaattttcatggggttattggccatttgtatatctttgcagaaatatctattcaactcttttgcccatttttaattggcttgtttggttttttgttgttgagataggagcttaggcatgcttttaaaaatgaagctaaaaacactatatagaagtagctattttagtttggattctgattgttgtttgtacagcctttaaatatgttctattaccaaagagcactggaatattgcaaaggatttatagcatattagtatattgggaaaagcacagtcttcatcatcagacttaaagtcaaatctgggctcacacttagcctgtgtgaccttgaacaagttagtaattacataaaacaagtattattttgataactaaaaggataataggttgagggtagtggcttatacctgtaatcctagcactttgggaggccgaggcaggaggatcacttgaggccaggagttcacgaccagtctgggaagcaaaatgagacccttgtctctacaaaatattaaaatgaaaaaattagccaggcatagtgtcacacgcctgtagtcccagcccctggggaggctgaagtgggaggattgcttgagcccaggagttggaagctacaatgagctatgatcatgtcactgtactctagcctggatgacagagtaagaccctgtcttaaaaacaaacaggctgggtgcagtggcttacacctctaataccagcactttgggaggctgaggcgggcagatcacttgaggtcaggagtttgagaccagcctggacaacatgacgaaaccccatctctacaagaaatacaaaaattagctgggcgtggtggtgggtgcctataatcccagctactctgggggctgaggcaggagaattgctcgaacctgggaggtggaggttgcagtgagccgagatcttgccactgcactccagcctgggcaacagagtgagactccatcccaaaacaagcaagcaaacaaacaagcaaactaataaaccaaaataattctactgtaaataataaaaattttacagtaaaaattcactataaataatacagtaaaaatttttattgggaagcagagggctttacttggttgtgcctccttaaacacatctcgctttagtcttagggacgggcacagtggctcacgcctgaggctgagtggggcggatcacaaaatcaagagattgagaccatcctggccaacatggtgaaaccccgtttctactaaaaaatataaaaattagctgagcgtggtggcacacacctgtagtcccagctacttgggaggctgaggcaggaaaattgcttgaacctgggaggtggaggttgcagtgagccaagatcacgcgactgcactccgtcccaaaaaaaaaaaaaaaaaacaccaaaacacacatctcattttagtcttaaaagtaattcatttgagcaactttttctttttcaaaaaaatcaactttgtatggaatgatggcttattctatttatgacaccatcttagttaagtatttgtcacttggtcactaaaaatgtagggggttgaaaatcctcaacttacaggatatcatgctgtgtatatactttttctgtttatgtagtgtaagaagaggtctctgtagacattatgcagtacatcagtttcagctctcactggcctgtaatacagagagtttaaatattatgtatctgttttaaaagttagtaaaagtaaattaacttgtccagcttgtaaacaaatcttttgaagctatgtcctttgtttctcttcagagatggttaatccctaatactaggctagggttgtatctgttatatgtatactctggtctaaaaccagagttaaatacgaaaaccactggactttgctgaaccacattagcttcacccatggcattctgtaaagtactttgactagattattgttaatggagacagtgacttctatttataacattcgtaaaaagagtttgaatttttaacgtactttagagtttataaatctgcaagtttttggttccctttgctgagaatctactgtttgagtctgagtaacttaagccagtggcttagggaaatttgcctaacatgtactaagctacttctccagttctcactaggcataattttgtgtatgttaaactttgttatttagatgtattacttgtaagaattcatttttaattgaagtcactccgtatgcatgttagttgggatttctttgcatccctggtaataaattggatataagatttattgttgtttttgcttccacaggatctgttaaagagatttggtttttataacaaggcagattaatgattaaattgatagaaaatttcaaataagttttttgcttttatacaattaatttttagtaattaaagggtcttgctatgattggaagaactgataatgagatatatgttttgtttattaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtaagttaatcataccactattcccctcacctcttattgtatcagagttcattccttgctccttctcattgctttctttcctctcattttctccttttttttgagacagagtctcgctctgtcacccaggctggagtgcagtggtgcgatctcggctcactgcaagctccgcctcctgggttcatgccaatctcctgcctcagcctcctgagtagctgggactacaggagcccgccaccacgcccggctaattttttgtatttttactagagacgggatttcaccgtgttagtcaggctggtcttgaactcctgaccttgtgatccgcccacctcagcctcccaaagtgctgggattacaggcgtgagccatcgagcctgaccttctccttttttctttaaattgttatgttgttgtgaactatatcgctgtgacagtgtattaaatttgtatgtagagtataaagaataataaagctctacatttattaagaaatagaacattaccattaccttaaaagccacctgagtgcctctctcatttgcattttcctccctcatcaccatgagtaatatctacctagattttttttttttttgagatggagtctcactctgttgcccaggttggagtgcagtggcacaatctcggctcaccacgacctctgcctcccgagttcaagcgactctcctgtctcagcctcccgagttgctgggattacaggcgcctgccaccactcccagctaatttttgtacttttagtagagatgtggtttcaccatgttagccaggctggtctcgaactcctgacttcaagtgatctgtccccacctcagcttcccaaagtgttgggattacaggtatcagccactgtgcccggcccctacccagacttttgtgttactcatttctttgtttttcatcatagtttacctgcataatatattgttttgttttgaaaactgaatggcaagcatgcacctagttggtgggaaggggcagtattggtacaattaggtgaagagtcccaggagaggataagctgaagagactttctcagttatagcaattccagcttcagtttccctaagagtttacaagagctacttctggagaagtcagagggtaaggttctaaatgaggccaggaaaatacacccatgtctcagcgcagtcagggcaccggcagggctagtgtgcagaccagaaattagttgtctggttaccatatggtttgatggggagtgggccactctgactctttgcttccaatctctctgtgaccagcccccactctcaatagtggatcacagaaggcaacttctgtggggtgaaatgcatgtccatacctgctccaggcagctgcagtgctgatgggagggtgtgcaggagccgcagcagcatgtactcaaaaccagccgagtacaaaccatctgcgccaggctcacctgggcattctggcctcaggttaaaaagaaggatggggcaatgacagtgggaacctggaaatgatagcctttaacatgtctttctgatcatactgttgttctaaactggaatgattattttggacatctggtacacaactatcaccctggcatttcccattaccatcttcctagacttctctgcttcactcctgtatttaattttggatttcctgaatcccatgtcttcaggggacatgggattagctgggtccactttcagctcctagaagccactcttcagtcctttccatgtctccaccccgtcttcaaagccagcaatggcatattgaatccttctagtgtcagcagctggtaaaagattcaccgagataatctccctagattaaggccaattgtgctatatattatagcaaacacaatgatgggagtgatatctcatatgcacaggtttggggattaagagggatcatcttaaagcagattgcaggactgagaatgatatgtcatggtacctcctcaaatgatcttctctactgttcagccctgttcctctgagatgacgaggcagaaccttttcttctctcactcctctaatgcctagtaagatgtagcactttgctgttagcatacttgcctctgcctagaatgttggtctccactccaaacttctgcacatccctcaatagtgtgcacgttccttttttggctttaattcaggtcagaacttaccttccaggctggatgtggtggctcatgcctgttatcccagcactttggggagaccgaggtgagaggattgcttgagcccaggagttcgagaccaaagcccaagcaatatagggagaccccatctctacaaaaaattaaaaattagccaggtgtggtggtgcatgcctgtgatcccagctactcgggaggctgaggtgggaggatcacttgagcctgggaggtcaaggctgcattgacctatcattgtaccactgcattctagcctgggcaacagagtgagaacctgtctctcaaaaacaaatcaaataaaatagaattcttttgtgaaaacacttactctattaccttcagagatgcagcgtgctcctacttaagacttttacagcagctcatttcaagttaagttatgtccatttcacaccacctgatagtgtgctcatacaggacaaaggaccaacttagtcacctgtatctggtgcctagtactgtgcacattgtagacacttaatgttgctgaatgaggaaacctttttaatccttcaaaaaacgtaatggcagttctaaattacctgtgataagactgcatattctgaaacatcaagttgttttgttcgtttttgtttaaagcctgaattattttaacaatgcttggtaatactattgatttttctcatgccaattagaggctctggcatttatgtatgtctttgtttaagagagaatatagaaacagattaactgttaatttggaatttgggggcataaaataactgctagtaaaaaaaaaaaaagttaaaattggccgggcgcggtggctcatgcttgtaatcctagcactttgggaggctgaggcggtggatcacgacgtcaggaattcaagaccagcctggccaacacagtgaaaccccgtccctactaaaaatacaaaaaaattagctgggcgtggtggcgggcacctgtaatcccagctacttgggaggctgaggcaggagaatcgcttgaacctaggagacagagttgcagtgagccgagatcatgccactgcactccagcctgggcgacagagctagactctgtctcaaaaaaaaaaaaaaagttaaaatcttaaatgttaaagaagtagtttgcttattatgttttgtttgtaggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtaacacagttacagcttgtaaaagcaaacgcatgtgcaattatattctctaatctttatttattttgaagggcagtggtcaatgacctattttgtttcttttcctttttgtatgtttgcttatctttaaatagcacttctgtgctctaaatagcacttctatcatttcatcaagccttttacaaaacccctgaaatagacaagccagctagtttccttattttaaaattaagaaactgttttgttaagtgattcttctaaggtgctagttgcagaaggatcataatctagcatctggttttgtttggggtataaataaaatgatcttattatcatttttgagggtctaacataaatcctttcttttttttgagacagggccttgctctgtcacctaggctggagtgcagtggtgtgatcatgattcactgcagcctcgacctccccaggctcaggtgatcctcccacctcagccccctgagtagctgggactacaagtgcgtgccactacacctggctaatttttgtattttcttttggtagagatggggtttcaccatattggccaggctggtctcaaactcctgggctcaagccatctacccgcctcagcctcccaaagtgttgggattgtaggcatgagccaccgcgcccagccacgtacatcgtttaataaagaaaatttagaactaaagataaaatttattcctcaagaaggaattttctagtctttaagaccctttgtattttaggctcaagtgtaacattaacacaattcctctaattttctgctgtaatgcattttcttttccagaaggacacagtatttgcatagtaataacctattgttctacaaagacagtattctaggttataggagaaagagaatatgatatattttactgaaatccttatgtcaagtgtagattagttagggatatacatgacatggccagcaaatggagttgatttttatctgattctctgtttttaggttggctttactaagaaaattttagttataccacaatgtcaacatttcattgcttgataagagtttacatgctggtttttgattaatgttgtagtgtaaatattttatttgaagctatgtcaggttctcagagtaaaaaagccattaaagaaacaccattacctataccatttggacattttgtgcttcaagttttcccttctacctgttacttattttctttttttataggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcaggggtgaggtgaactgttatatttttaaatatataatcagtgtatttactgtaaatgggaaagtttatctttaatctttttttccccttattttaacagttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaaggtaagacacattttagaggttctgtattcatttaaacaaattaaacactgcctagattttctgacaggcaaaagttctcttttataaattcattatagtttagagaaaggtcaccaaaagctaaaagttgtttatgctttccttcacccaagacattccttttttttttttttttttttttgaggtggagtgtcgctcttgctgcccaggctggagtgcaatggtgcaatctcggctcaccgcaacctccacctcccaggttcaagtgattctcctgcctcagcctcccaagtagctgggattacaggcatgtgccaccatgccccgctaattttttgtatttttagtagaaacggggtttctccatgttggtcaggttggtctcgaactcccgacctcaggtgatccgcctgcctcggcctcccaaagtgctaggataacagacatgagccacagtacccggcccaagatgttcctcttaatgtgtctaatattgtgtaactagaatcttgagatactgcttgtataattggagaagaaacagagaactcagtatatatggacaaaagatttatttaggactgatctcttcctcttattcatgattatttgttctttgtattaaacttttccagcctgatttgaacatggaaggatgtctgttgcagttaattagaaatagtgtttcatagattttcatgatttttagcatgttcatctaaactcttgacttgttttggttcatgtttatttctgtaggagaaataagaagtgtttttgtctttcagactcttaaagtcagcattattcatttctgacaatgagttaatagtctttgtgtgagtttatatattaagactatatcctggttccctaggttatggattctggatgcatggttgcatttttctttgccattacccggttttctcctctcacctcccaccataccttgcgtttgtcttccttctctgggagtgagatgatctaatagctgctagctaacagagaatgcctgatttagctagttgctggtgcatcttttaagagattagtatattatcagttcatcatcaaacttttaatgattaccaccttctggggatatgaaataaaataaacatgatccttgccctcaaagagcccagtcttttaggggaaagcatgtatgtacttgacaaatgccagatgcatttaaaatctgctaggggtagatttagtttgatatagttgaagatgccagatatttggctagtatttataagtgatatggtgcctatttgtaattgagctcatgtggtagtttgatttgcctctttctaagcctataatgcaaagtgtgttgaatgggagcttaaatttaacttaggttcaatttacataagcatacaggtatgtgtattttaaaatgtgttccaaaaatttaattatcaaaatgttacttgcttattttaaaataaagcccataaagttatgaaaaagaaagtgaaaaattacttgttatttctccagctagagacaacttattgttttttcattttgttttgttttgtttcgttttgttttgttttttttgagatggagtctcattatgtcgcccaggctggagtgcagtggcgcgatctcggctcactgcaacctccgcctcccgggttcaaacgattcttctgccacagcctcccgagtaggtgggactacaggcacgtgccaccatgcccggctaattttttgtatttttagtagagacgggctttcaccgtgttagccaggatggtctcgatctcctgacctcgtgatccgcccgcctcggcctcccaaagtgctgggattacaggtgtgagccaccgtgcccggccaacaacttattgtttatgtttgaggtatagcctttagatttatctttttttctgtgtacacatgtataactttgtttatatatacacatgtatatcacatacatatgattttttgtagcctgcccttttcacctaatatatagaagccacataagcaagaaatttgattatatgggtctttttatgagcatggtagcccaaattctaggaattattgcagccaatcagtatttatttctgccaactctctcctctcttcttgagagagtatctatattcattttaggaatgatactgaaatcctttgagctttctcatgggacttccactgtcaggtgtgtgacaatgtcagattcggatactcagaatctctgccagggtttgaatgagttatgtagtaaattgcgataaataagaaaccatgagtggtatattgctgtgacttgtctcaaccccttagtgtattcagttaactagcatttactcatggtattaggatttttataggactaatgctatacctagcacctttttgataatttgctgaaatttttggaacatagcattattttctctatcagtatgtccgggaaagtcccattaaaatgggcatagtatatgcatttataatttgaattctccttgtacctgtagctggcctttggagcagatagaaaaactttagcccaacctatgactttagacttgtcagttactggagttccacaatcagtcctttctttcttttttttttttcagacagagtctcactctgtcacccaggctggagtgaagtggtgtgatctcagctcactgcaacctccgcctcctgggttcaagcgattctcccacctcagcctcccaagtagctgggactataggagcacaccagcatgcctggccaatttttgtatttttagtagagatggggttttgtcatgttggccaggctggtcttgaactcctggcctcaagtgatctgccccgccttggcctcccaaagtgctgggattacaggcgtgagccaccatgcctggccacaaccaatcctttctgcagtttctcttcagacgttttctgcttcacagatgacttcccagcatccaacagttggtcttcaacttgagcgtgatcctagaaatgggaatcaggcattaaccaaagcaccagatgccagtcagacttctagtttcttaccggttaatcaccctcaagctttgttgaatcattcttctgtccaacatgtgagcagtgcacagaatgctgctagtacagctcagctcccttctaattccattggggggcattcaggggcccatcagccttcacaaaagatacattcagtatcacagccatacccatcagaagtctctaacttcagattcttcaatgccacaaagccagactgtgcaaggagtattgtttccaagcttgtattcagcaacaatcattaattttacaacctaagattttggcatctccacagaaaaatgttcagcaggattatgttctccaagagtctgaagctcttgcaagtcagcaacagccaaagggtggtattgaaagtgtgattcagcccctggaatagccttcttattctgttcaacacacttccagggccacctgcggaattatcatccttcccattgaaggctcctgagcagctgccctttgtgatatgtccccagcaacaaacttcttactcatcacagccaacttactcaattcaggctccactacataaacagcctgtttattcactgccagtcctggagcatcctctttacactgtacaaccaccgagatcacagccagcctattctgtgcagacttcttatccagtcccagctgcagtacagccctcatatttggcaaagactcacgtgcagtctgcttatctagtgcaacctctgcttcagtcaccttttccagaccaggcagcatatgcaatccaggcagcttaccttatgcaacctatggaacagcttgcttatcagacactgtctcttgagcatgtatcttatttaggacaaactgcttacactatccagataactgaacatgcaaccttcataacccagcaggtatatacaataagccctcctgatagcaagtgagtacacatgacagacaaactctgcacatcagaagttatactctgtaccaccatttgtagcacagacttttgagcaacaagcctatttaacacaaccccaaggtagttcttcttcaacattggaacaaaggatgtatttaataccaaccttagatacacagacacattctactgagcctttatttaatgtccagctttcagcgactccatcccaagcagatgtcagttttggacaccagcagctaaaaactcaggcccaggcaactagcattatatctcagagggcagtggaaggacagcttcaaaaccctgagcagatgtccttcattcagcaggcctcttcacaggcacagatccagcccccacatttctcagcacagttttcccaatcacatctagcaccaagccaggtttttcacttagctttcattcagcagcagcagatgactcattcatctcatagacaagcacaggaaacccatcagttgtctactcaggaaggtcccataaatcaacagcaatctttatttagtcaacatgctgctctccagcagcaggtacctcattgacaggcacctaagcaagttcagccattaccaggtattccaaacaccattacaaacatggtccagattatacatccattgcaagaacagttgcaactggcagccctggaacaacaatatataatacagcctttagagcagcctcaagtacttcaggcactagataacagtctgacttttcccctacagaaaaacctagcacaataccagccagcatacatccagcagcagtctgctgactggccgcagtggtagccatcttacagcttagcacctgtttctgggtcatcagagccacaattacaacagcagaccctctatcaaagctctgggatagcccttccaaatcagcaatcttcagttcatctcctgacacttagcattctggtagacgcttccactgcttttcagagcatttctgtgttacacacacagcagcatttacaaggccaagaaattccaacggtaaatcctcgtgggggaaaataaggatgattgtgatttttctgtgatgtttaagggtcaggatgatagtgaactataatagatacagcacttcagtgggagtcatggtccctgttcctgactcttttccttacttactgagtgaccttgattcaggtcttttctaaattttctcatctgtaaagtgaagggatcagaccagatgactacaattaaaaaaaatttgaggacctacttaggatataacagtgaataaaatacaaaaaccccttctgtcattgaggtttgttgtctaatggggaaagattgtcaataaccactataaaaaggaaattatacagtacaaggtgctttggggaaaatgtagaggaggaaaaggaggaaagtgggttgcaggtttaaggaagatggctatcagagtaggtctcattgagaaggtaacatttgagcagacacttgaaggaaataagggagtcagtaatgtatatttcagacagagggaataacaggtgcaaaggccctaagggagaagtttgtctggcatgtttggaaaacagccaggaggcaaatgtagctttccaagatcctttagtcctaaaacgtttggaacctatggttctcttattgttctacatttataataaagcatttgcctttgtgagataatactattgagtgattcttattgccaaatactatcccaaaggcattacatgtacatcttcacaccaaccctaggaatcccattattacctttttttactgatgaagaaactgaggttcatagaggttaagtaacttttctagtgtcatacccaaaagctagcatttgaacccagcatattcaatcattttactacccatctgctttgaaagatagttaccctccccaccagaattggagaaaaaggttatgatggcttcagtgagatttagttaatttggggaattgattgctttttttttttttttgagatggggtcttgctctgtcacccaggctggagtgcagtggcgccatctcgggtcactgcaatctctgcctcctgggttcaactgattctcctgcctcaacctcctgagtagctgggattacaggcatctaccaccacacccagctaatttttgtatttttagtagagagagggattcaccatgttgcccaggctggtctcgcactcctgacttcaagtgtttcacccacctcagcctcccaaagtgctgagatcacagacgtgagccaccatgcccagcccttgattgaattaattaaagcaaagaactgagaatctgacttattctttttgctcttctcccctgctttaggtatatctaaaacacactgaatttattgtttggctaataaaatactttgaggtccttagataaaaggtgtgctatgctgtatgagttattttctagtgataatatattactctaccaaacagctattacctcaggtattctgtattttataaaatctcctcttcatcaagggcataaattataatggatttcagtatgtgcgtgctgactcctaacaggactgagcgagaataaataaagatctttgcagctgaagtttcttcagacaggggcatactattctgggatttatttatttcagattaaggggtttaacaaaccattttttcttctccccccccacctttttttttttgtttgtttgttttcctgcactacacagatgtaattaacaaagtattttggattttaatgttcattctgtgggcagattgcacgtgttgtatactttccttacctaattaaaacgttttccccaacatcttattaagaaaaacttcagatatacagaatattggaaaaaattgtagcatgaacacccatatacctaacacctaaattatacagttaacttttgctctatctgctctatcacatacctatttatccctttattaatccattttatttttctggtgcatttcaaagtttaaaggaagttgccaacatcagtatacatcatccataaatacatatcattgactagaactcagtatttatgttttttagtttaaatgtatatacagtaaaatgcataaatcataattcatgagtttcgacaaatgcttacacctatgtaaccccaaccattatcaagacatagaagaggtgttgacagtctttttctgtaaaggcctagatagtaaatattgtaggctttgcaggctatataatctctgttacagttactcagttctgctgttgtatgcatgaaaacaaccataaatatgtaaacaaataggcgcggctgtgttccaataaacatttgctcacaaaaacaggtggtgtgccagatttggcctgaaggctgtggcttgcccacctgatagagaatattgccattactccagaaagttccctcatgccccttcccagtgagttttctccacacccgttagagtcaatcgctgttgattatttgttgttgttttttgagacaaggtcttcctcttttgcccaggctggagtgtagtggtgcaaacacagctcactgcagccctgacctcctggctcaagccatccttgcacctcagcctcctgagtagctgggaccacaggtgcgcaccactccgcctggctaagtttttgatttttttatagagacggggtcttgccatgttgcccaggctggtcttgaactcctaggctcatagggtcttcccacgttggcttcccaaagtgctggaattacagatgtaagtcaccatgcctagccaattttttcaccatagattagcttagcctgttctagaccttcatataaatggaacaatataatatatattcttgtgtaaggcttctctgattcaacatgtttttgagattgatccatgttgtgtatgtatcagtagctttttttttttcttttttgagacggagttcgttcttgttgctcaggctggagtgcaatggcttgatctcggctcactgcaacctccacctcctgggttcaagtgattctcctgcctcagcctcccaagtagctgggagtacaggcatgagccaccacgcccggctaattttgtatttttagtagagacggggtttctccgtgttggtcaggctggtctggaactcctgacctcaggtgatctgccagcctcagcctcccaaactgctgggattataggcacaagccaccatgcccagccagctcattcttttttgtaactgcagaataatgttccattttatggatataccaaatttgtttatctatcctattcacagacacctaagtgatttctggttttgggctattgtgaataaagctgcaatgaacatccctatataagtttttttttttgtaaacatgttttcatttctcttgaattatacctagaaatagaattgctgggtcatagaataagtgtttgactttttaagaaattgcaagttttccgaattggctgcactaacaccagcaatgtatgagagctccacaccctcaccagcatttttaattttagttattctagttgttgtatagtggtatctcatcgtggttttaatctgtatttccccgatgactatgatgttgagtaccttttcatgtatttgttggcctttgtatatctttgtgaagtgcctgttcaagtcatttacccattttatttgctcatgtttgtctttttattatggatttacagaaattccttatatatcctggattatacaagtcccttgtcagatacatgttttataaatatattctccagtctttatattgcccattcgtttttgtaatggtctcatttaatgagacaaagtatttaattttgatgaagtctgattcatcaaagtttttctattgtagttactactttctgtggcccatgaaacctttgcctacacccaagttacaaggaaactttcatatggtttatagttttatgtttaagtccatggttcatcttgaattaatttttatgaatgctgtgaagtaaggggtcaagtttctttttttttttttttcctctaggaatatcctaacagcttcatctgttgaaaagacatccctttctccacatctctaccaacacttgttatctttttttttttttttttttttttgagacagtcttgttctgtcgcccaggctggagtgcagtggcacgatctcggctcactgcaagctccgcctcccaggttcacgccattctcctgcctcagcctcccaagtagctgggactacaggcgcctgccaccacgcccggctaattttttgtatttttagtagagacgggatttcaccatcttagccaggatagtctcaatctcctgacctcgtgatccacccgcctcggcctcccaaagtgctgggattacaggcgtgagccactgcacccagcccatctgtcatttttattgtagacatcctagtgggtgtgatgtggtatctcattgtggttttgatttgcatttttctgaagactaatgatgttgagcatctttctatatgcatataggtcgttcatgtatcttcttttattatctttggagaaatatctattgaaatcctttgcccagtttttattttattcttttattttattttttgtagagatgaggtctcgccatatagccctggctggttttgaactcctggtctcaagcaatcctcccaccttggcctcccaaagtgccaggattacaggcatgagccactgcgcctaacccctttacccagtttttaattgggtatctttttgtctttttattgttgagttatgagttctttatatattctggatacttagaccattatcagatgtatgctttaaaatattttctcccattctgtgtgttgtcttttcaccttcttgatggtgtcctttgtggcataatttttttaaaagtttgataaagtccaatttctcaatgttttctttcgttactttgtgcttttggtgtcatatctaagaaactattgtttgatccaaggtcatgaagattttctcctatattttcttctaagagttttaaattttagctcttaaatttgggtctttgatccattttgagttaattgttgtatatagtttgaggtaggggtctaatttcattctatccatgtggacatccagtttttccagtgccatttattcaaaagactattcacccattgaatagccttggcacccttgttgacaatcaattcaccataaaagtatgagtgttccaacttagttttcctttctcaggattattttggttcctctgagtcccttgcatttccacatgaattttgggatcagcttgtcaagttgtgtccaaaaagccagctgggattttgataggcattgtgttaactttgtatattgcttgggtagtattgtctcttagtaatatgaagtcttcgagtccaggaacatggatgtcttttcattaaactaggtgttctttaagtgttggcaaaggtgtggagaaaagggaacccttgtacactgttgatgggaatgtaaattggtgtagccattatggaaaacagtatgaggctaggtgcagtggctcacacctgtgatcccaatactttgggaggctgaggcacgaggatcactttagcccaggaattcaagaccaacctgggcaacatagtgagacctcctcgtctctacaaaaaaattaaaaaattagctaggtgtggtggcatgtaccccatagtcccagctactcaggaggctgaggcagaaggatcccttgaacccaagaggtcaaggctgcagtgagctgtgattgcaccactgaactccagcctgggcaacagagcaagaccctgtctcaaaaacaaacaaacaaaacagtatgaaagttcctcaaaaaattaaaaaaaaaaaaaactatgatacaatccagccattccacttctgggcatatatccaaacgaaaagaaatcagtatcttgacatatctgcaacctcatgttcattgcagctttattcacaatagccaagatatggaaacaacttaagtgttgacagatgaatggataacaaaaatgtggtgtgtgtgcatatacatacatgtatatgtgtgtatacacacacatacaaagaaggaaattcaggaaatcagccactaaaaaagaaggaaatcctgctatttgtgacaacatggatgaaccaggaggacattatgctaagtgaagccagatacagaaagatactgtatgatcttacttatatgtggaatctataaatatcaaactcatagaagcagagagtagaacagtggttggcaagggctgagaagtaggagaaatggagacacttggttaaagggtataaacttttacttataagatgaataagttctagggatgcaatgtattatttagttgaaaaaaaatttttttttgagtcagcgtctcactctgttgcttaggctggagtgcaggggtgcaatcttggctcacacaacctctgcctcctgggttcaagtgattctcatgcctcagcctcccaagtagctgagactacaggcgtatgccaccatgcccagctaatttttgtatttttagtagagatgggatttcaccatgttgtccagactggtctcgaactcctggcctcaagtgatccgcccacttcagcctcccaaagtgccgggattacaggtgtgagccactgtgcccagccctaaaagagatcttaagtatcctcaccacacatacacgtacaaagggagggtaactttgtgttgtgattgatatgttaattaattttattgtggtaatcatttcacagtgtatatgtatagcaaatcatcacattgtacatcttgaatatatacaatttttatttgtcaattatacctcagtaaagctgggaaaaaatagctggtttttaatttcagcagtattttgtagttctcagaaaatcttttttttttaatttttcaacttttattttagaatcagggagtatgtgtgcaggattgtcacagaggtatattgcatgatgctgaggtctgggatatgactgaactcatcactcagatatggagcatagtacccaatggttagtttttcagcttttttccccatccctttctctcccctctcatagtccccagtgtttactcttttcatctttatgtccacatgtacccagtgtttagctcccacttatatgtgagaacatgtgataatttggttttctgtttctgtgttagttcgcctaggaaaatggcctccagctgcatccttgttgctgcaaaggacatgatttcattcttttttatggctgcatagtattccacaagtccttacaattccttgtaaagttttttcctaagttattatttttgttgttattataaatggaattgttttcttaatttccatttggattgttaattgctaaggcatacaaatacaactgatttttgtgagtttccattatatcctgtaattttgctaaatttgtttatcagctccaatagtttttttgtagattctgtaggaatttctctaataaaatcatgtcatctgggactagagatagttttaattttgctttccaatttatattttttttttttttgagacagagtcttactctgtcacccaggctggagtgcagtggcacaatcttggctctctgcaatctccgctccccgggttcaagcgattctcctttctcagcctcccgagtagctgggattacagttgcctgccaccgtgcccagctaatttttgtatttttaggagagacagggtttcaccatcttggccaggctggtcttgaactcctgacctcctgatccacccgcctcggcctcccgaagtgctgggatttacaggcgtgagccactacgcccggcctagatgtttattttttaaaaaattattcttgctggaacttctagtataatgttgagtaggagttgagagcaaatatcctgcttttcctaatcttagtgagaaaattttcagtctttcaccattaagtatgatgttatctgtgtctttttacttttaaagaactttattcaggcttagtttatgtacgataaatgcatatatttatagtgtacagttaaatgagttgacagatgtatgccataatcaagatacagaacatttccagaacacccaaaagtttcttgtgtcccttttcagtatttgtatgtgtgtgtttactctagggattttaatttacattctgaattcttcacagtttttacatagatttaatattataaaatgtaaggaccatgcaactatttatttcctgcaggctttaagctataattatttttgtttgtttgtttgttgaggtaggatgtccttctgtagcccaggcaggagtacagtggttcagtcacagctcactgtagcctcgacctcccaggcccaaacaatcctcccacctcagcctcccaggtagttgagaccataggcatgcaccaccacacctggctaatttttttaatctgtgtagagacgggtctccctgtgttgcccaggctggttataattgttatgtatattacatctacatacattataaactgcacaatgcaatgttatagtttttgccttatataaacatatgccttttccaagaaattacgaagagaaaaagttttaaattttggtgaggtccagttttttttttttggattgtgctttttgtgtgaagtctaagaattctttgcctagccttagaactggagatattcttctacttttacatttttcatttcagtgtgatctatgttaatgtttttatttattttattttatttatttatttatttatttattttgagatggagtttcgctcttgtcgcccaggctagaatgcgatggcgcgatcttggctcactgcaacctccgcctcccgggttcaagtgattctcctgcctcagcctcccaagtagctagaattacaggtgcccgccaccacccccagctaatttttgtatttttagtagagacgtggtttcaccatgttggccaagctggtaaactcctgacctcaggtgatccacccgccttagcctcccaaagtgctgggattacaggcatgaaccaccacgcccggcctatgttaatgtttttttaagttagaggcattcacaaggtaatatgttaatcttgtatatggttttgagatttagattcagggtttttttttggggagggagtttccctgtagatgtttaattgccatagcatcattgaaaacactgcttgtcttccattcaattgcttttatatttctgtcaaaaatcagtttggcttatttgcgtgggtcttttcttctgggttctctattctgtttaattcatttatgtttttaactctctgttaattacatactctcttgactactatagctatatagaaagccttaatattgggtagtgtgattgctacccaatattctttattctttttttaagtttttttttttagctcttctggatttctgtttttccatatacattttagaataatctagtctatgtccacagaaaaccttgctgggattttgatagtaattgtattagtcctatatatgactttggggaaaattgacatcttgactatgttgggccttcaagttcaggaacatgatatgtctcttcatttatttagatcttctttgatttctttcatcagcattttgtaattttcagcatacaaatcctaaggctcttttgttaagtttgtgcctaagtatctggtttaattttgaaggattataaataattgtgctcttttttttttttttttctgaggcagggtctcactctgttgcctaggctggagttcagtggcgtgatctcagctcactgcagcctctgcttcccaggctcgagcaatcctcccaccacagcctcccaaagtagctgggactacaggtgcatgccaccatgcccggctaatttttgtacttttagtggagatgaggttttgccatgttgcccaggctgatgttgaattcccgggctcaagcggtccacccacctcagcctcccaaagtactaggattacaagtgtgagccactgtgcctggctaatattgtagtttttaatgtcagttttcacatgttccttgttagagtatagaaatgtgatcgtgtgtgttgatgttgaattcaaataccttgttgaacttacttatttgtcctaggaggatttgtttgtttttttggtagaatccttggaaatttttttaaatatagaaaatcatggccgggcgcgttggctcacgcctgtaatcccagcactttgggagactgaggcaggcagatcatgaggtcaagagattgagaccatcctggccaacatggtgaaaccccgtctctactaaaaatacaaaaattagctgggcgtggtggcacgtgcctgtagtcccagctactcgggagactgaggcaggagaatcccttgaacccaggaggcggaggttgcagtgagccgagatcgtaccacctcactccagcctggcaatagagcaagactccgtctcaaaaaaaaaaaagaaaaaaagaaaatcatataatctcctaaaatagagacagtgtgatctctccctttctaatctgtatgctttttatttcttattttccttttattgtgctggctagaatttccagtactgtactggaataagagtggtgagaatgtactgtcttgaataagagtggtgagaatgaacttccttgctttgttccgagtcttaggggggacaagtctttcaccattagtatgatatgagctacagattttttatagatgctctttatccagttgaggtagttaccctctattacctgactcactgagaagttttattatgaattaatgttggccaggcgcggtggctaacacctgtaatcccagcactttgggaggccgagacaggtggataacctgaaatcaggagttcaataacagcctcgccaacatggcgaaaccctgtctctactaaaaaatacaaaaattagccgggcgtggtagtgggtgcttgtaatcccagccactcgggaggttgaggcagggagaattgcttgaacctgggaggtggaggttgcagtgagctgagatcgtgccactgtacttcagcctgggtgacagagcgagactccttctcaaaaaaaaaaaaaaaggaatgttgcctttttcagatgtttcttctgtgttaatgatatgattatatggttttgtttttttttacttgttgatatatagtggatgacatggatttcaaatatcgaaacagccttcatgtccttggaataaactcatttggtcatggcatatgattctttgcatacattgtttgattcactttactaatactttgttgaagatttttgaaccttaagttcatgacagatactgatttgtagttcagttttatgtctttgttaattttctattattaattgctgagagtgaggtgttgaagtttctaagtataattgtagatatatgtatttctccttttaacgcagtaatttgtttttttttgtttgtttgtttgtttttgagacagagtctcgctctgtcacctaggctggagttcagtggcacaatcttggctcactgcaacctccgcctcctgggttcaagcaattgtctcagcctcctgagtagctgggattacaggcgtgcaccaccatgcccagctaatttttgtatttttagtagagacgagtttctgccatgttggccaggctggtctcgaactcctgacctcaggtgatccacccgcctcagcctcccaaagtgctgggattatagatgtgagccaccgcgcccagcctacacagtcatttttttttacttctgttttgaagctcttatttggtgcatccacgtttaggatggctatgtctttttagtggattgatctttttatcattatattatatccctcttcatttcttgtaattttctttcctgtgaagtcaactttatctgatattatgtactccctgctgctttttattgcttaatgtcaacatgatatatttttccatccttttactttcagcctatcctatgtttcaagtgagtttcttgtagaaagtgtatagttaatgtttatccatgttttttatcccttctgtcaatgtctcttaattggcatatttagactgttttgcattcaaagtaatttttgatatgctaggatttaagtctatcatgttagtatttgcattttgtttcttctctatgtttctccttcttatgcttctcttttcttacccacctgtgggttatttgaaattttttaggattccttcttggttttcttttgcttggtcatgaacttcttgttttatttatactgttttgagtatattatactgtacagttttcttagtggttgctctaaggtatccatacacacacacacacacacacacacacacacacacacacacacacacacacacacacatatgaacttataccctacagataccgacattttaccacctctagtaaaatattgaaatctgagttccatttagatctgtttaccactcccacttttttctgagccggagtctcactctctcgcccaggctggagtgcaatggtgcgatctcagctcactgcaacctccgcctcccaggttcaagcgattctcctgcctcagcctcccaagtagctgggattacagctgcctaccaccgcacctggctaatttttgtattattagtagagacgaggtttcaccatgttggccaggctggtttcaaactcctgacctcaagtgatcttccctgcctcggcctcccaaagtgctgggattacagacgtgagccactaggcccgaccttttttttttttttttttttatgtgacagggtcttgctttgtcacccaggctggagtgcagtggctcagtcatggtctactgtagcctcaacctcctgagctcaagcaatcctcctacctcagcctcacaagtagctgggactctaggcatgtactaccatgcccagccttttgttgtttttgttttcttgtagagatggagtcttgctatattgcccaggctggtctcaaactcctggcgtcaagcagtcctcctgcatcaacctcccaaagtgttgggattataggcattagccaccatcagctcccatcatctttgaacttatctgtacacaagaagatgttccagacctatcctattcttccttgccccagctttataatcagtcatctccagtgagctctggttgagagggtttgttttcatggagaaataatctcatttataggaagaatgatttaggaatgagggaaaatttcttgaaataggaaaaaaattaccgtagtgatgtccttgagaagatgagaggagatgacatttagtttctacatagaggggttggccttagcataggagtacagttgtccataataataagcgtgaaggtagagattatggccataaatgctatttaggtgggtggatgttatggaaattatctttttgttgccttttttattttctcagtgaaatggaagcaatgtcatcagctgagaatgaagttaggggagggagtgtgtattagaagtttaatgatggaagcaaaagtattaaatagttacatagaagaatggtagtagaatgaatgaacaagggaaatgtagtgagattgccaggcagcattaaggatcctcttgaagttaattaaagagttaatctctttgttgagtttggtgcttcttttttttctaagttttagtgtttctcaaggatttggtgattcttggttttttattcagtcatatttaagggtcctgttcacctgtctgatttgtttacttacagtagcctgccttgctgccagttactgtagaggagagacaagttgtgttgggagcacgttttcttagtagtttgttacctgtagatttgttcttcctctcaggctctaccttgagtttttgggcaaatttccttgctgctcactatttagcataatgaggggttaggagaggataggattgcctagcctagctgctgttaattcaccatatcatttaatctcccagatgaattccccaaagccaggcaatcttctggtatccattgagtagttttagagcttccccaaatcactcctaactttgcaatagttttctcctatatgtgcgtttgaagctttggtttccatatattttgttccccatggatgtgatctattggtttctgttcttttggaaggttctttaccatttatggtctgtggatggcattctttttagtttttctgggatgttatgactttattctagtttttgttttttgctttaagatgggagtctcgctctgttgcccaggctggagtgcagtggcacaatcttggctcactgcaacctccgccttccgggttcaagcaattcctggctaatttttgtatttttagtagagacagggtttcatcatgttggccaggctggtctcaaactgctgacctgtagtgatctacccgcctcggcctcccaaagtgctaggattacaggcgtgagccaccgtacccggccaattctaggtttttaaagtaataatttctgttgctttctagagtattaggtagttggtaagacagatgtatacgttcgttgttaccatattgattcagtcacagaatttctcttatctacatgaataatgtggattgacattaaaagggaaaataacttagtgattttgttgttgcaaatatctagcgttgacaactagaagcaggggtttcattcaggtttttgttgatattgttttcataagtactgactggattggccagatttcagactttgaatgcatgaggagtcattgaaaggttatgtattacttgttttcatggctaaatctacatattagcatagctgagttgtgtatttgtaagattactctagaaattgtggttctattttctattttactactattcatagcttagccaatggaatcatttgctttgttaattccagtttcttaatcagtgaaggtaatatctttatacttcagtctttatcttaattctagccatggtatgttttagacccatatagttactgtggttatcagtggttttaagaaattggctttgtttctggtgacatttctattcttttagtgcttacaaaacagtacagaaactatatgaagaatggactctgttgatgtgtataacactgacattaattggcaaaagattctctacgttcagtttgttcagaaatatccatgggcctactgtgagtgaatattattaaaacactccacacctgtattctggtaatgaccattttattatgtaaccagtttctgagactagctggctgccttccttacttccttcctccctcccttcttcccaccctcttttttcatccttttttttttcttttgagatacggtttcactctgtcacctagtgcagtggcactatcatagcttattgcagcctcgaactcctgggcttaagtgatcctgctgcctcagcctcccaggtagctgagtctgaggcattctaatggagtgaaacttatagttagggagttgacattttttgaggacctgctatgtatcaagcagtgtcatttcgtttaatcttcactgtagcttcctctataaagtagttaattccattacatggaaatatttgtgtaaaaatcgagaaagttataactgatttctctagagagatattctagtttccagggaatcagactatttctgtaaaaatgctatttagcacagtattgtatttatgtgaaattgctttattctaattgaagggaaatcagtttaaacagtgggtgtgtttgctgaacattgtcaaaaagtgttcccaaaaggcatgtattgctttgtatctattcatattgttgaaactggtaataataaggacattagtcatttggattgatttccagtgacattattcagccctctcccttttgtaatgtaaatcagttagaatactgaagatgttgaagtggggagaacctttcagattgatctcatttttccaggaaggagccagcttcgtaaatagcagcacagttgaactcttcaatttgggaggttggttgaatgagctaaaagactgattatttgcggattaccatgataaggtatttaagaaaaaggcaaactgttgttttgggaggatagcaattatgaaagctttttaaaataattttatcatattatacatgttatattcttgatttatatgtgtacattcaattttgaaactacaattctaacaatttggactcaatattaactattggttttagtatagatcaccagtttttataccacatattctctattcttgatttttaaattttgctaagtacctgtgtagtttgaagaatggctttgtgtaatttttcaaagttacttgggtttgaaatttctgattctttggatatccgaaactgacgtttcatttacattcacacatgaacaaaaacttgttaggcattaaaaaaaaatcagtttacagtctttttttcccatctacatattttgttcttttgtcttcttctagctaatgcttcagaagagaagcctaggcctgtctgattttttttgttcccttttcctcctaagtgcttataggtggtattctttatctttataagtaaaaagtttggtatatatatttttttaattttcagaattctttgggtatggcatacatcttttatatgtcttggtatggatcttttatttcctcacataaaaatagctttttaggctgggcgcagtggctcacgcctgtaatcccagcactttgggaggccaaggcgggcagatcacctgaggtcaggagttcaagaccagcctggccaacatggtgaaactgtgtctctactaaaaatacaaaaaaattagccaggcgtgcagccataaaaaagaatgagttcatatcctttgcagggacatggatgaaactggaagctattattctcagcaaactaacacaggaacagaacaccaaacaccgcatgttctcactcataagtgggagctgaacaatgagaacacatggacacagggaggggaacatcacacaccgggcctgttgaggggtcgggggaaaggggagggagagcattaggacaaatacctaatgcatgcggagcttaaaacctagatgacgggttgataggtgcagcaaagcaccatggtacatgtatacctacgtaacaaacctgcacgttctgtacatgtatcccagaacttaaaattaaaaaaaaaaaattagccaggtgtggtggcaggtgcctgtaatcccagctacttgggagggtgaggcaggagaatcgcttgaacccagtggtggaagttgcattgaaccaagaccacgccattgcactccagcctgggcaacaagaaagaaactctgtctcaaagaaaaaaaaaaaaaaaaaagaggccgggcgctgtggctcacgcctgtaatctcagtactttgggaggccgaggtgggcctgaggtcgggagttcaagaccagcctgaccaacgtggagaaaccccatctctactaaaaatacaaaattagctgggcgtggtggtgcatgcctgtagtcctacctacacaggaggctgaggcaggataatcgcttgaacctgggaggcggaggttgcagggagccgggatcacgctgttgcactcgagcctgggcaagaagagcaaaactccatctcacacagacacaaaaaaggagctttttaaaaataacttttcttctcataaatactttttaaagtacagaaatgtataaagaaagttaaagttacctatgatcctacctctcaaaaacaaaacttttgtagtttttctagacattttccatgctatgtgtgtatgaaaaatgtgtggtattttatcagaattgaatcataccagctgttcttcaaatttttttttacaaaggtatatacattcattaaggtatcctaaatgtacagtttgatgagtgttcatatatatatatcttcatgaaatgcaaatgaagatatagaacacttccagccccctagaaagttcaccgagattcatctacattgttgcatgtatcaatagtttgtttcattgctggtagttgttctgttgtagaatatatcatgattcagttatccattctcctatccatgtacattaggattggttctagtttttggctcttatggataaagctgctgtgagctttcctgtatattttttggtgaatatatgcactcatttctcttgtgtatatacttaggaatgggattgttaggtcacagaataagggtagttttagccataccttatattgccagacagttttccaaagctattgtactgaaatacgttcccgctggcaatgtatgagacttccatttactctgcatccttatctgttgtcagttgtttaaattttagctgttttgatgagtttgatgtggttatatattgtggtttttaacttgcattttcctgataaataatgatgttgagtgttttttcatataattattagagattcaaataccttctttggtgaagtgcctattcaaatcttttaatttttgtatttagtctgttttaattttgagcgattcttcaacctttttctgtctttcttgacagtattgcaatgcagaggccagttgtttttttttatagaatgtctctcagtttgggtttgtttgaagtttcctcatgattatattcagataatgcattcttggcaggaatactgtgtgagtgatgttgtcttcttatcagtgcatcataatagaagtaatgccagtttgtcccaatattggtgaagttaacttttattacttggttcaagtggggcctgccaagcttctctactgtaaagttatcgtttcttcccttatagtttatgagttatttgtggggagatattttgaagctatgtaaatatccctttcacttactagttttagcatccatttatgattttctagctccatcattcctctttattagttggccattctccctcatttatttatttatttatgttagtatgaactcatggggaccttattttatttactaggttatagtataatactatcattatttatttagatggttaaaatgccctagatttgggggaccattcatggtagcatttgtgtccttttgacattttcccatcattctttgaacacttccttattttctggccacagcaagacagatattccaggctcattttgtcttttccctgcccctaccctggaatccagctatttctccatggagttctgattcctttaatttattgatttatttgcatttttaaaaatttttttgaggcagggtcttgctctgtcactcaaggtggagtgccagtggcaagatcatggctcactgcagcctcaacctggctcctgggctcaaataatcctcccatctcagcctcccaaatagctgggactatatgcatgtgccaccacggccagttaatttttttagtttttattttttgtagaggcgaggtattgctcagttgcccaggctggtcatcaactcctgggctcaagcgatcccctcgcctcagcctcccccttattccttttagtgggtaatgtaatttagaaaaaaagcctgagtattgggtgtgtttgctgctactggggagttattgcttctagagttctcagcagacaggctaggaagtgtgtgtgtgtgtgtgtgtgtgtgtgtgtgtgtgtgtgtgtgtgtgcacgcattcagatatcttaggtgactttgcttttgactttgtgttctaggagagaatttatatattttttgccatgtatctccagtgtacatgcaagatctccacttggttgtataatgacgtttcaaattaagtatatccaaaatcgaacacttacatttgcactttccaccaccccaagcctgctcttttcactgtcatccccatctcaacaaatagcaactctgtctttccttactcaagccatatggctatggtttttttgttgttgttgttgctctttttttgagagagtctcgctctgttacccaagctggagtgcagtggtgctgtcttggctcactgcaacctccgcctcccgggttcaagtgattctcttgcctcagcctcccaagtagctgggattacaggcacttacaggcacacaccaccatgcccgcctaatttttgtatttttagtagagatggggtttcaccatgttggccaggctggtctcgaactcctgacttcaagtgatccccccacctcggcctcccaaagtgctgggattataggtgtgagccaccacactcagttagctatggtcatcttttattctttgctttctctcatattccacttcaaactatcagcatgtcttttgactctttttacaaatttttgtgggtaaatagcaggtgcatatatttatgggggacatgagatattttaggcctggggatggtggctctcccctgtaatcccagcactttgggaggccaaggcaggaggatcacttgagccgagaagtttgacaccagccaaggcaacatggcgaaatcctgtctctaccaaaaagaaaaaattcttttttatggcttcatagtttcctatggtgtatacatgccacattttctttatccagtctatcattgatgagcatttgggttggttccaagtctttgctattgtaaatagtgctgcagtaaacatacgtgtgcatgtgtcttcatagtagaatgatttataatccttttggtagatacccacatgtatgaagctggaaaccatcatcctcaacaaactaacacgggaacagaaagccaaacactgcatgttctcactcataagtgggagttgaacaatgagaacacatggacacagggaggggaacatcacacaccgggacctgtcgggggatgtggggaaaggggagggagagcattaggacaaatacctaatgcatgcggagcttaaaacctagatgacaggttgataggtgcagcaaaccaccatggcacatgtatacctatgtaacaaacctgcacgttcagcacatgtatcccagaacataaagtaaataaaattatatatatatatataaataaattaaaagttagctgggcatggtggcccatgcctgtagtctcagcgactcaggaggctgaagtgggagtattgcttgagcctgagagatcaaggctgcagtgagtcttaatcacattattgcacttcagcctggctgacagagcaagaccttgtctcaaaagaataaaaagagatattttgatacaggcatacaatgcataataatcacatcagggtaaatggggtatctatcacctcaagcatttatcctttgtgttacaatctaattatactcttaattatttttaatgtacaattaaattatcaactatagttgacttgtgctattaaatactagatcttattcagtttttctgattaatttttgtacccattaaccttccccactcccctcctgactctccccactacccttcccagcctctggtaaccatccttctactttctatctctatgagttcaattgttataatttttagctcccacacataagtgagaacatgccaagttcatctttctgtgcctggcttattgttcacttcatataatgacctccagttccatctatgacaatatctcattcttgtttattgctgcatagtgctctgttgtgtatatttgatttgactcttactttaacatatatctgcatcctgacttctcaacaccttcaccattgtcgtgctggtctaattcagctctttttttttttcgctgtcttgtccaggctggagtgcagtggcacgatctcggctcgctgcagcctctgcctcccaggtagctgggagtacaggcacccgccaccacatctggctactttttgtatttttggtagagaccaggtttcaccatgttggccaggcaggtctcgaactcctcacctcaagtgatctgcctgccttggccttccaaagtgttgggattactggcgtgagccactgtgcccagcctcatctcttgaataattgtagtagtctcctaattgttcttgcttttgcttttgttcttttgtagcctttttcttattgtaggaagcagtgatagttttaaaatgcaggtcacaacatgtctcagagacccacaacctctcgttgctcatctctttgatagtaaaagccacaataatgtactaatggcctgcaaagtcctacaggatctggactcccctgcacaactctctgacctcatgtagattttctttgacttccgttttcctcttttttttcagacggagtctcgctctgtcacccaggctggagtgcagttgcgcaatctcggctcactgcaacctctgcctcccaggttcaagcgattctcctgcctcagcctcccaagtagctggaattacaggcacatgccaccacgcccggctaatttttgtactttcactagagacggggttttaccatattggctaggctagtcttgaactcctcacctcaaatgattcgcctgcctcagcctcccaaagtgttggcattacaggcatgagccacccacaccccgccccattttcctcttgaatgatgattaaaccctttcataggcctatagcttgaggacaaggagatgcacactttctgtgtattagtaagcattgatttattctggttcttctgtactgaagtgtggtttactttttttactcccataatgaattatccaatgttctgaaataatcaaatactttaaagactatgatctccaacatgcagggctgccaaaatgtgtctgcatccttgctcatttggctttacttataagatctctaccttccagactgcgaaatggctcagtctgtcctctccttttcttctccagtatgcattctcattcttgccattaaaaaaaaaaaaaatgttagttgctctttccaaatatctgtagaaagctttgcagggctgaggcaagactgtgcctgatcagtttgttagttcttacagacctttgatcacttaacggggcagtattagaataaaagtttggaatttaagtctgctttcatgaagttaggctcccctcaattcagttctatctgccttacagttaatggaacttcttcctagttcctatcactctttcatctctcatagttcctatcactcttttatgtgtcagtctttgtagtgctggtatgttttcatcattttggcctatgtaataggctggatgtcattatgtgagttttatcccaggaaccgtgcttttggatcagttttttaacttagggtaaatttcatcgttcaggcctggcacggtggctcgtacctgtaatcccagcactctggaaggtcaaggcaggaggattgcttgggcccaggagttcgagaccaacctgggcaacacactgacacccccatgtctaccaattttttttttttgagacagtctcactctgtcacccaggctggagtgcagtggcacaatcatggctcactgcaacctccacctcccgggttcaaacaattcccgtgcctcagcctcccaagtaactgggattacagtcatgtgccaccacatctggctaatttttgtatttttagtacagacagggcttcaccctgttggccaggctggtctccaactcctgacctcaggtgatccgcctgcctcagcctcccaaagtgctggattataggcatgagccaccacacctggcccaaattttttttaaaaaaattagccaggtgtggtggcacatgcctgtagtctcagctgctcaggaggctgaactgggagaatcactttgagcctgggaggttggggctgtactccagtctgggcaacagagtgagaccctgtctcaaaaaaaaaatgtttagaatcttgccttcaccaacaattggccttatacaagacaacgtctttatagatgaagaattctatataaatataaaaatatggaagtgggcatcatgcacagtgataattttatttaattaaataagcaaaaattccactgttaaccaggtatatacagcatacatataggcttgagccaatttgtgtcattggtcagacctggatttcaactctggctctttgaactcactgtgtgacttgaggaaagttatttaatctcgcccagctttggttctttttagtgtgaaatggttttaaatggttgtaaaagttttaaaatgcctatcttgcatttgcaacctactttgaaatatatgggataatgtacatatagtaaaatcctgtagactatgggtggtgttagatatataggttttcacagaacaattccacttttctatgtgttggaaaatttttataatgttagaaaaaatgcctgtattgcaggcttattaggattaggtgatataaaatatgagaagtgtctggcatgtaataggtactcaacaaatagtggttgttaaaagtacttcaggggagagatatgctttgtaacatcaataacataataaagcaatttatgaaatgtttaaaagtacatcccagttttactggtctccttcactccataataactgaataagaatctctgggatgttgtacatgggcttagctttttatctcttttgtcctcccatctccccttctggggctgagaaccactaatgggaggaggagaggagtggtggagcaagtaaaggagaaagatcctcctcaacaccttcccgaggtttggcattacataagacctcagaaccagttaggggagcctcaagaatataaccaagattgattccctgctcctgccccagcagaagtagctgtatctacttttcttttcttttttttttttttttttgagacagtttcactcttgtcacccaggctagagtgcaatggctcaatctcagctcactggaacctccacctcccaggttcaagcagttctcttgcctcagcctcctgagtagctgggactacaggtgcatgccaccacacccagctaatttttgtatttttagtagagatgggatttctccatattggtcaggctggtctcaaacttctgacctcagcctcccaaagtgcagcctcccaatgtgagccactgcgcccagcccactctttattatatatgtttaatgtttgactccagggactccatcagattcattttgtatcctcactgcctcttagcacagtgcctgctacacactaggtttccaataaatgtgtgaaggtagaaataagaaaggaaagggtgacataggaagaaaaactgtgccataaaaatgttcatgatctgatattgccaatcctggaaataaatctgaagaaaataataaaaaggaagcaaaaagcacatactacaacgcttgtttcatagtgaatgttagctatctctgtatttttgctgtatttttatttatatgtaataaaattggcagtaagttagttatccaggaataggggaggagttagataaatatgaatacttattgtcctatcatgtgcccattaaaaactgaagtaatgcaggccaataaaggtaaggaaaaatacttaatacattttaaaaagcagaaaaaactgtataattacaaccatttatacacatgacaaaagcctatagtattgaaacaaatattataatcacagccatgttaggaaaacagcattctaggtgatttttcccattttcctacattttataatgttatatacatttaataattaaacatttttataggatagcaaataccaaatgtagaggaaaatggatactttcacaaacctctggtaggactgtaaactggttagacctttctgaagggcaatttggcaatatatatcaagccttaaaaatgtctagcaattccatttttagaaaggcttcctaaggaaataattaagaatgcatacaaagatttggctacaagaatgttcctcacaatatgaaatatagttgcaaatagcaaaaaaattagatgtttgtctcccttacttgcaccattaaataaataatggtatgtttacactaaaggatattatgtagcccttaacatgttcttaaacacttaagatgttttcagtaaaaagaagattataaaagagtacatacattatgattacattaaaaacgtgtgtgtgtgtgtgtgtttgtgtacagaaaatggtctcaaagaatatacaccaaggtgttaaacaagcttatctatattcatcttgctttggtaataagaaaaaaataaattcaactttgtacaaacagacttaccaagcctcaaatctgataatcttagggtaggtcatcattatatcaatatgcaacactatagtacaatcgtcctttggtatctgtaggggattggttccaggacttttcttggataccaaaatccaaggatgctaagccctacagttggccctgtggaatcacacacatgaagtcagccctccatatccaagggttctgaatcctgaaaatactgtcctgtcttgtcttgtctttttctttttcttttttttaagacagggtcccaggttggactgcagtggtgtaatcataggtcactgtaacttcaaactcctgggctcaagcattcctcttgccttggcttcccaaagtgctgggattacaggtgtgagccaccatgcccaggcagaatattacattttcaatccaagattggatgaacccatgcatgtggaatccacagataaaagggctggctgcagttttaaacaaaagtgaaaatgggccaggcgtggtggctcacggctgtaatcctagcactttgggaggccaaggcaggtggatcacttgaagtcaggagttcgagaccagcctggccaacatggtgaaaccccatctctactaaaaatacaaaaaaaaaaaaaatagccgggtgtggtggtacgcgcctgtagtgccagctactcgggggctcagacaggagaatcacttgaacctaggaggtggaggttgcagtgagccaagatcacgccactgcactccagcctgggtgacagagcgagactccatctcaaaacaaaaaacaaacaaatgaaagtaaaaatgaaacatttcattaaatttgaaagacatctgcaaaaatggcccagcacctatttgtaaatattaattttgaaacctttagaaatattatgacagagcttaacttgtacctatcagatatgaaggcagataaaccaaacattagccatgattctgagcaccagcacaaagtagcattaataaccccattaataattgcaagtgattataaaatatatttccatattattgtatagtagctatgttttgtttctctttgattagtacatacacttgtctctggatttatgcattaggatgccagttgctgttccaacttacggggactgtacaaacattagttaaattagatacattttgttgaatcttaagtgtacaaaaacactatttgccgaaatatttgctctcaatgtttaaacagtaattatgttaaagagctaattaactaatctataattagaagctagtctaatttatgcaggaaaaaatttctcagtatgggttgattagaatgatgaaatagtttgaaatagtttagggaagtggaggaatataagtagagtcacaatatgcagaagagcctaatttatacagaggagctacagtttagcgtggcttcaaacagagagataaggctagataatcaggtataggccagttcattgagaacattatttgccatctgaaggaccttaatcttatagaagatgaggcaccatcatatagggtttaaactgggtaaggaaattatcagttttgttagatttgcattctaagatcactctgctatcactagtggcagtgcatagaggatggattaggtaaatgtaaaattattttccagtagaattggtatttgccctattaagagcttaaacacttttctcctggaagccaatgttgcagctgctgagtactaattccttgaagggatagttgaaatagtctagagaaaagagatgagagacagacagacagactacacaataagttaatgcttgagtcattgatttatcttcttgtagaatggtagtacctcttcttttaagtagtagtcttacaactaggactggaagctcgatagtagtgtcttccattgaaaaataactcaaaacaaaagtacatataacagtaataactttttcaaatgaaaaatcttcatgtataagatgtacttgttgtattgttaaattttatttatctttggtaataatgttaataataggattgatacagacattcaataacatagatattctaccaggtttgcaaggtaaccaaaactatcgtgttttctgaatagtaacaaattgtatatttagcttgaattttactgttatcatagcaagttttatgtctgtactgtttacagcctgtatcccaaccagttggagctgaacaacaagcagctcttctaaaaccagatttagttcgaaggtaagtatcttcaaattaataccatgagaacaatgaggatatgctgaagtttgtttactcattaggtgcttagtgcatcctgactagagaagcttctgtattcttgtacttgtgtggatgtttaataaagacgatagtttttttttttttttttgcttttttatgtcagtagggatcatatggattgtgaaattaattgatcattttcttattgtgtttatttataccattctgttctaggaaaagctggtaagggttaaggaaggaagaaacaatagagtttagagtagaattctagctaatctaaagaaataaattacaactagatatttaattgtattattatttagtacttgaaaactagtatttttctgtataaaaatatagattggatagtctttattgttctttcttcaagttcattgattgtttcctttgtcctgttcattctactattatgcctattcagtgaggtgtttttttttttctgtgattgtttatttctatactttctatgtggttcttcttaaaatcttctatttcttttataagattttggttttttttcatttgcctcaagattatttgtgattgctcattgaagcattttgatgatagctgctctaaaattattgttagaggccgggtgcagtggctcacacctgtaatcctagcactttgggaggctgaggcaggcagatcacttgaggtgaggagttcaagacctgcctggcaaacatggtgaaaccctgcctctactaaaaatacaaaatttagccaggtgtggtgatgtacgcctgtaatcccagctacttgggaggctggggctgggggattgcttgaatccaggaggcagaggttgcagtgagctgacatcgcaccactgtattccagcctgggtgacaaagtgagactctgtctaaataaataaataaaattcttgttagataattccaatatctgattcatcttgttcttttttttttttttttttttgagatggagtctcactctattgcccaggctggagtgcagtggcacgatttcggctcactgcaacctccacctcctgggttccagtgattcttgtgcctcagcctcccaagtagctgggattacaggctcgcaccaccacgcctggctaatttttgtatttttagtagagacagggtttcaccatgttggccaggctggtctcaaactcctgagctcaaatgatctgcccgcctcggcctcccagagtgctgggattataggcgtgcaccacagcgcccagcctcatcttattcttgttagatgatttcaataactgacttatcttggtgttggcatctgttgattacctttttgcattcaagttgtaatttttctagtttttggtatgacaaaggagtttattttcatttgtctcctgggcgtttggatattgtcaggtgactgtagatcctatttaagtctttttttttttttttttttttttttttgaggcagagtcttactctgttgcccaggctggaatgcaatggcgtgatcttggctcactgcagcctccacctcctgggttcaagcgattctcctgcctcagactcctgagtagctgggattacaggcacatggcaccatgcctagctaacttattttagtagagacagggtttcaccatgttgtccaggctggtctcaaactcttgacctcaggtgatccgcccacctcagcctctcaaagtgctgggattacaggcgtgagccaccatgcctggcctattgaaatcttctatgttagcaagcagtcgcccttgtttagatgcataggttctggcctgcttttgtgggccgtgattctgatgacaatttagttttcaaaatccttacagtgctgctattctggtttgttttgttcacctgaacccctggcccccactgctgggccaagaggtggagagtgcttccctaggcctgctcccccaggtgtgctctacaggctatactctacttactggtggggctcctaccagcggcactggggaaggacagggcctacttaagtcctcttctgttgctgggttggggatcaggagatactgtgcttgggctgcctttgcctctggactgggaattgggagacactgcctgtactgcctttattcactgggtggataattggaagataccaagctgctatgatgttactcaagtcctaggggtccccagccagtccgctttcatcttttcactcttctgtgccctcctgtcattgtctactacattatttctagaacttttagctgtacttagaggggaggagcagggagagttgagtttctgccatcttgtcccaaaccctaaactgatgtgttaagtaactttggaatgtgaatgatatagcccattggctaaaattatattccttttatcctctgattacttgttactgccatttctctgtgtatttaaaaaactcttaagggcagtattaatgtatcttcttccactacttatatttatgtcatacgtcatatggacataaaaaatttaggagttatttttatctcttgtacatctatatatagatgcttcatgagtagtttttaggagaaataacttgcttaaattaacttgaaagatatctatttcaaaaagatgtctgagacttagagcttgtcatttaaattccaaacgtgtttattgaaatttttgtatttgttgaaatatgtttgagtttaaagaaaaacctgaaaaatgcctttgacgcagataaactaaaaggtagcctcccctttcataataatattgatgtagacctgtaaaatgtaactaattagaattaataatgttgagctatttttacatcattcattttcatatcttgttctgcctcctgcagaacactattcttgtctcccatacctggtctaccctgttgagttcattacataaacaagtatattttgagtgataatttgttttggttttagaagttttgtttgaagatattaataaagtaaccaaacaaacaagataaaactgatcaagagcaccctataataaaaggctccacagaggtctatcactggcaatatttttctttcattctcatcactgtgagatggtttgctaaatgctaaataaatacagtgtgaccttgatttttcagctttttaagaaagctttattgaaatataattcacataccatataattcactcatttaaagtgtgtaatttaatggcttttagtatattcacagagttgtgcagtcataacttttaaaaagattgtagtattaatttttcttaaattcattatttatagttttataattgggagtttttcttagaattttactgtcaagactggaatgagttacttttttaaaaatattactagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtcagtttgtaaatatggtttggttaagagtacatatagaggtctggagggtcagagaggggcagtgctgcagaagtgagttgtagaatattgcgagaccctctctaaactaaccttttctccgttacagactttccaatgtgagtattatgtgttcgttgttaaacttaggaaatataagaaagaaaataaaatctacttttaaccaccattcagagatagctcctattaatgttttagtttgtttttctctccttttcctgtatgtacatgtagtgttttacattattgaggttgtaatagtactagtaatcgcagcaaaaatctattgagttcttttgtggtaggcaccctaaatgttatccatgcattttaccatttaatccttcaataaccctgtatgataggtcatagtatatactcatctttacaaatgaagatactaaagatcagaggagtgagccgggcgcagtggctcacgcctgtaatcccaacactttggaaggccgaggcaggtggatcatctgaggtcaggagttcgagaccagcctgaccaatatgataaaaccccgtctctattaaaaatacaaaaattagccaggcatggtggtgcatgcctgtaatcccaactactcgggaggctgagacaggagaatcgcttgaacccaggaggcggaggttgcggtgaactgagatcacaccattgcactccaacctgggcaacaagaacaaaactccatctgaaaaaaaaatgaaatcagaggagcgaagtaagttgcctaagatcactcaactagcaagtgataatgtcagatctgaacctagatcggactttaaagcccgtatctctaaccaatataatgtatgttttagttggctgcttaaacctatatataattttatatcctgcatttttaaaaacctaatatatcatgtatgccttcctgtatcattaatttttcaataacatgacattttaaatggctacattagatagctgcttatacagagaaataacttacattccctatgttcttggtttatgttctttctttccatctttttcccagtctgtcttttttctaacttgctgtcttttactctttttgtctgtctgtatatctttgcagcaaaatccttgaacataaatctttgtatctatccctgattatttccttattagatccataggagacggattcatggatcagaatatgaagatttttaaagtttctagatacatgttgctagattgctgtccataaagattggtccaggttacatttccatttgcagtgcctcttcttttgcttagagtcaatttatagattaagataattttggaaatgaattattaaatttaaatctttgcattgcagatagctctagtgactattataactttttttgctttcttataaaagttgtattgttttctttaccacaggatcacatttataacttattttttactgagtaacttgaacctgttagtttagtcatagaatggctgtttagatggtattccaccaagggaaaacattctgaactatttaagccattttccacatatattgtacgtgaactagtgtagatgttccttgcacaatttgcaaaaagaagacagtgattgactcttaaaccggtaaaatgtttgtactcaggtatcaacctctggagataacatggtagagtgtcagctggagacacacaacaacaagatggtcaccttcaagtttgatgttgatggtgatgcgccagaggatattgcagactatatggtaagtgcagtaagaccaaattatcttcccttcagcattctgtcttttttcccctataattctgtctccatttattttgagccattgttttttagagtacgattagttttaaaattttgtacagaggtaaattgggttatcatcaagtgtaagtcactgcatctcctccggtttcagtatatttaactggaaaatatgcagaggtttcatttagagataatatagctaaatggctcttatctctgattgcatgtgaaaatcacctgacaagctttttaaaaacaattgtattgcctggtcccttgattaaatcagaatatttggaggtgaggcccaagcatcaatagtttgtaaagctccccaggtaattcttttttttttagtttattttttgctgggcacagtggctcatgcctgtaatccccgcactttgggaggcctaggcaggaggatcacttgagcccaggagttcaagaccagcctaggcaatgtagtgagtgagaccttgtcttcacaaaaaattaaaaaatgccagatgtggtggccacacttgtaatcccagcactttgggaggctgagggaggaggattgcttgagcccaggagattgaggctgtagtgagctatgatcatgccactgcattccagcctgggcagcagagcaagaccctgtctcaaaaaaaagttaccttttattatttttattttttataacaggctttgaaaaagctaaagccccaggtaattctttttctttctgtttttttttttttaatttttgtggctacatagaaagtttatatatttatgaggtacatgagatatttcgatgtaggtatacaatgtgtaagaatgatgtaaaggtaaatggggtatccctccccttgtaattctaatgtgttagtcactgatctaacatcttgcatgttattgtttcatttagtttttaatattttctttgaattgttaggtttaagttagtatttcttccccccttattttattatttttttttattattttctaggttacttttccatcttccccttttttgatggggatgggactaggatggcaggaagagtgcatataatgctttttgtttctgccagctttctttgtgtatgcatttctagccaagcagaattaaacattttaaaagttaattatttcatcatcagttctgttcttgtttaacgtaatattttctgaactgtctcttctttcattcttttcaggaatgtttaacctaattagtggtcttccgagctattttttttttttttttttgagacagagtctcgctctattgcccaggctggagggcagtggtgtgatcttggctcactgcaacctccgcctcctgggatcaagtgattatcctgtctcagcctcccaagtagctgggattacaggcgcacgccaccacacccagctaatttttgtatttttaacagagatggcatttcgccatgttgaccaggctggtctcgaactcctgacctcaggtgattcacccacttcagcctcccaaagtgctgggctaccgtgcccagccttccgagctattctttattttctttggagatgtttcattttgtggtttgtgatttaaaagcttttgggtttggacatcttagttttaaacattgcctcagttatgttcttcaaataaccaatttatagaatgacatattttttaaaatgctggttccttctctggtaggtagtgccaatctgagaaatgtcagtagtctcagaataatttaatgtattttttggcattttattgctggtctttgtgaattctattgtgacacttggatttagatacttaattttaattttattcttctttttctttttcttttcttttctttttttttttttttttgagacagagttttgctcttgttgcccaggctgtagtgcaatggtgcaatctcagctcaccataacctccgcctcctgggctcaagcaattctcctgcctcagcctcccaagtagctgggattacaggcacccgccatcatacccagttaattttgtatttttagtagagacagggtttcaccatgttggtcaggctggtctcaaattcctgacctcaggtgatccacccacctcagcctcccaaagtgctgggattacaggcatgagccactgtgcctggcccaattttctttctttatgtgatagtcactatttatataatattataactttgaagaaactgaattcattctcatgaatagacttacttttgggcaggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccaggtgagaacaattgtttagcaaacagatcttctcagatatgaatcaggaactttttaatttatctattcatttttaattcagacagggtcatctgaacaagtacagataaattctacatctactcaaaccagcagtaagtatatttagtaaaatttatcatttggtttttgaagcaagacatttgaaaacttttaacacaccttcattgggaaagatgttagccaataaattaatttggtaacttattagtgtaggttttctcacactttgaaaggcccaaaggtaataatccatcccctgacttttccccaagtgttggttctttatctgattgatttatttttgagttattgggtggtcatgttaccagaaaagcagtcacagtactgatgaccttaaatggcataactgtttgaaacttaactggtaagttatttttttctgatttgagatggatagaaactttttaacaaaagtcatcattttctaagtttgcctcatatttcaatagtcattcgtatcttgattttattctactaacgatgaatgatatgcttctacttgcgctggtcactgataacttttagtaaatcagataccagataaacttccagaagcgaaaactagggtctcctgttttcttttctgatgactttatctttccattcttctcagttctggtcatgggtatattaaagagtgtctgggagggggataagagccatagacaaatgagcacccctgaagaaattacaggaacgtaaagaagcaaaaggtggtgtgggagtaatagaaccagataccattatcctgaaatttagtttgactgtgttaggatgcagtccttcctatatcttatttttctggttagccaagatatgagtaggtttctgactaacaaagttgggtagagtttaaaagagaattacttatttgagtacatttacaaagtagcagttaagatgtaggggtttattttactttattttaaaaaatgtcatacagtaaaactgattttcttttggtgtacacttctgtaaattttaatacatgtatagatttatataagcactatcataatcaggatacagaataagagatataggttttaatgagaaaagtgctgtcagttttttcaaagagtaccctgtttctaattgctattcaagcaatatttgtttcagtagaatctaaaatccttctctaaagatattgtgtgcttagtactttagactttttgtcagtattaaaagggctggtcttatcaattacatatattctagtactattagaaatggagatataagacaaattgtttatttaacctggcttcttcagtcaataaggtaaataaattgaaaatagcttagcatattattttttgctaattatttctgcagatgaatctgctcctcagtcatccccagttggtcggtggcgattctgtatcaatcagacgataagaaaccgtgagactcagtctcctccttctcttcagcattccatgtctgcggttcctggccgacatccacttcctagtaagcttttcttctctgccagctttgtccagactcaaaggatgggatgcaaaatacatatgatatctttaactggtttccatgggaattttatgcttatgagaattttcataagcttttttgaagacattaatattaggatacaacttaagccatttcctatttaatatttatgagaaaaaaggaaaacattatttcccttgacaggttgaattctgtgttttgagtcttatttacgagagtactttcacacaggttctcatttgcccctttgtcctcctgttccttttgacttagggtactagtctgtgctttgtactcgtcagtacgtgcttagccattctttattattgttccaggtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgtaagtatcattctttctaaccaattccttactctttgcttattgttttaaagaaatgccttctcttctaaaattctgtcctttgagatgaaatggtctatgtcacaagatgctgaggtcacaggtatttaagaaggctatgacttaggctgcaggtgttcagaacctctcagtagagatgacaaactatctttggtaagagagccctctggtgaattagctaagaacttgcaagcagtgtctatatttgtattaatgacagaatgaaaactgactcatggattgttttagtgggtaggaagaacttttagattttcacttaaaatgccagttatccgtttccttctttaaaaaaaaaagttatggtttttaatttaatcatgtttggggggatttaatttgacaaaaaaagagaagaaaagaaagtaaaaatcatcattaataccatgacttttttttttttttaaaccctagacggagtcttgctctgtcgcccaggctggagtgcagtggcatgatctcggtctgcctcccgggttcaagtaattctcctgcctcagcctcctgagtagctgggattacaggcacgtgccaccacgcccggctaattgttgtattagtagagacggggttttaccatgttggccaggctggtctcgaactcttgacctcgtgatccacctgccttggcctccaaagtgctgggattacaggcatgagccactgtgcctggcctgacttattttatgagttatataatgtaggaactttaattttccttttctgccccttcaaatcacaaaagtaaccactaataatttgatgcttattcttcttgacttttcttaagcttatacagatctatttacatacatataacattatattcataaaaatactgtgctgtatacatactgttctgcaacttaattttttcattttacagtagatcatggacatctttctaaatctttattgctgtatctttttgtcatttttgttattatataagtaataatatatacttgtacatagtatatatgtactacgtacaagtaaaatccaccccatccccaaacctgtagacacagctgttaacaaatctttccagacatgattttaattaatatacaaatatttataaagacatactttttatatatgatatattgtatctttatatagatatagatacatgttaatatttatatacatatacttatttacatatatgctattctgcatttttttcatttatgggtatctatccatgtcagtacacatagttccatcttactcaactttttgaaacaactgcataatattccactgatacatataatttaaagatttaaaaattttttaaattattttaaataataaatatcacataatgtgattcgaatcttaagaaatgaactgttatttctgtcatttaaactttgttgcttgaaggagactctcccaagtgtcaaggtcaaatgaattcatttatttgtttcaagtgtctgttgctatatctggatcatacttagctgccactgtttctggtgtcatggaattcttcttttttcccctaaaatacttctatgagtaatattttcaaatatattgcatgagtatcctatttggtattcttttgcatgtccaaaaatgtctttatattgcttcacacttgattgactaagtacagatggtaggatcagaattttttcttctcaatttagaagacagtgttttattgtcttttattagccttcctgatgagagtgatgtcagttgtttatcattcatttgtaggtaacctgtttttactctagaccactgcaatgctcttgtactttttacaacgtggaaatgttctgtatctgcactatccaatacagtaaccactaaccagatatgactattgagcacttgaaatgtgactagtgcaactgagggcctgaatttttaatttaatttaattaatttaaatttagacagccacatgtgattagtggctactgtattcagttagcacaggtctagttgctcttagggaactatcttagagctctgattatcagactgtatcttggtatatcactttcccattcattttgtatatcacttttgtggatgtttcgaatttgaagatttgtgtcttttttcagctccggtaactattttcatttcttttttttcttccccttcattgtcttgcttatttccatttagaaattgtaggagatatatggcctcttggattattccccatgtttcttaacagcttgctctcacttttaatttcattttttaaaaccttatgttctcagatatgtcttcagttttttttttctttttaaatttcagatcactctcttggtattcagctgtatccagttaatttttcatttggcagtcatgaatttgattttttaaatctttcttattcttggctccattttcatagcaacctatttttgcatatatttttgttccaagcttttttctcagaaaactgacaaaatattaactctaaaatatataaagaatgcttacaaatcattgagaaaagatcagacaactcagtggaagaatatccaaagcatctgaacgtgcatttcacagaagtggaaatataaatgcctgctaaacatgtgaaaagattttcaactttcttagtaatgagagaaaggcaaaattttatggaaaaatagttttttgctaatcagactagcaaatattaaagaaattgatggctgggcgcagtaattttcattttatgttggtaggaataaaatcagtacagcctacttggagggcaatttaacactatgaaagttagaaatgtgtacattcctgtgactgagctatgtcactgtcaaattctacctgagagaagtatttgcacatatgaacaaaggaacatgtataagaatgttcagtgtaacattgtttgattattggtaacaggaaaggattcacaaacaagtttaaatatttgtaaatagaaattgagggacactgatactatgaagcaatttaaaagcatgaagtagacctataaatatatgttagctattatcatctttattttagcatggacatatctccaggaaaaatcatcaggaaaaatatatgcagaataattcagacagtatgatgaggtgtgtgtatgtgtgtgtgtgtgtatatgtatgtatgtgtatgtgtgtgtgtgtttttgagacagggtctcactccattacccaggctggagtgcagtggcatgatcgtggctcactgtaacctcaacctcctgagtttaggtgatccccttgcctcagcctcccaagtagctgggactacaagtgcgtgctaccatgcttggctgatttttaaactttttgtagagacatgggcttgcagtgttgcccaggctggttttgaactcctggcctcaagcaatgctcctgccttggtctcccaaagcagtgggattacaggcatgagccaccacacctggcctgtatttttaaaaaggaacacacacacacacacacacacacacacacacacacacacacgcatatatatgtacataaatgcacaaaaaagttctgaaaagataaattgatattagtggatatcttccaggggagactgggaaggagggttgttacagggatttttgttttatctaatggtttagatcttttacagaaaacagttattcatgttataagccaaaaaatatctaaggcagatctcaatcaatttagaattttattttgccaaggttagggacatgcctagaagaaaggaaacatggaatcacagatacagtctgtggtctgtgcctttctccaaagatgattttgagggcttcagtatttaaaggagaaaagcaagctggaggggaaagagggaggttatggtaatccacatgttgcaagagaaaaggagcaggtaggagaataatcaattatgtattcatctcccaattttgctcagtaaatcagcactttacataagataaggtgaacatagggtagctacctctggagatatttaaccttttatttgtagctgtttgcttaggaacaaaatgaaatgcagtttcttgcatgactcagctttcagcttaatttttttctttttggcatagtgaattagggtcctgagtttttgttttcctttcacaatgtaatacttgtaatattttttaaatgaaaacattcttattgaaacagtgttagaaagaaaacagcttttgaaccccacaaaccagtttcaaaatcttgctttgccatttactatgtaatactaggcaaattatctacaccctttacccagccttaatttcctcatctgtaaaatcgagataatagtacctacttaaagggctactggatgcctttggtatattctctttattgtttattcatcttatttcatattctttgtgctctataaatatggaaacttgtcttgtgatttcttagaattttaactcttttacagtgttcgatccagtgacattaaatttgttcacaaggttgtgtatccatcaccattatctagttccagaactttttcatcaccccaaaaaaagaaacttcatacccattaagcagtcattattcattctcccttcccccttgccccttgcaaccacaaatctgctttctgtcagtatagatttgcttatgctagatatttcatataaatggaaccatacagtttatggcctttgtgtctggtttctttcacttagcataatgtttcaaggttcatattccattttatggctatactgcattttgtttatccattcattggtttgtggacatttaggttgtttctaccttttggctgttgtgaatagtgctgctacgaacattcatataaagtattcatatgagttcctgttttcaattatctggggcatatggtaattctacgtttaactttttgaagaaccaccaaactcttttctaaagcagccacaccattttacattcccaccagcacaatgtgagggttccgatttgtccacatacttaccaacacttgttttccaattttttgatcatagccatcctggtaagtataaagtggtatcttattgtggtcttgatttgcatttgcttaatggctagtggtgttgagaatcttttcgtgtgcttgttggccatctgtatatcttctttgaagaaatgtctgttcgagtcctttgcctattttttaattgggttgttgtttgtgttgttgagttgtaagaattcttttttttttttttttttttttttgagacggagtctcgcactttcgcccaggccggactgtagtggcgctatcttggctcactgcaagctccgcctcccgggttcacgccattctcctgcctcagcctcccgagtagctaggactacaggtgcccaccactgcgcccggctaatttttttttttgtatttttagtagagacaggggtttcaacgtgttagccaggatggtctcgatctcctgacctcgtgatccgcccgcctcggcctcccagagtgctggaattacaggcgtgagccaccgtgcccggccgtaagaattctttatatgtgtggctgggcatggtggctcaagcctgtaatcccaggatttagggaagccaaggcagtaagatcgcttgaggccaggagttcaagaccagcctggtcaacatagtgagaccccccatctctataaaataaaataaaaaaaatctttgtatattctggatgctaagtctttattagatattttatttgtgaatattttctcccattctgtaggtttgtcttttcactgtcttgatggtatcctttaacgcacaaaagttcttaattttgttgaagtctgattatccacttttccttgtattgctttgttagctcttataattacgtctttgatatatgttgagttaatttttgtatatgtatgagacaagggtccagcttcgttcttttgcatttggatatccagttgttcagcaccatttggtgaagaaactattctttcccccatttaatggtcttggcattcttgtaaaaaatcagctgactatatagatgtatggatttatttctggactaattcaattcatcactcccaatatctatccttatgccagtagcaaaatgacagtgttttgattactgtagttttatagtacatttggaaatcaggaaatgtgagtcctccaactttgttctttttaaatattttttggctattcagagtcccctgtgattccatatgaattttagtataagcttttctattcctgtgaaaaaggccattggggttttgatagggattgcattgaatctgtaggtcactctgtggactgttgacagattaagtcttcctgtccatgaactttctatttatttcagtatccttgaatttctttcattgatgttttgtagttttcagtgtataagactttcactccttggttaaatgtattcctaagtattttcttattgttattagaaatggaattgttttcttaatttctgttttggattcttcattgctagtatataaaaatacaactgatttttatgtgttgatgtatcctccaactttactgagtttgtttattagctccaataacttttggtggattattttggattttctatatataagagcatgtcaactgtgaatagagatagttttatttcttcatttcccatttttatttttcttatatacaaactttttttttttttttgagatggagtcttactctgtcgcccaggttggagtgcaatgggatgatttcagctcactgcaacctccacttcccaggtccaagcaattctcctgcctcagcctcccaagtagctgggattacaggcgctcaccactacgcctagctaatttttatatttttggtagagatgaggtttcaccatgttgaccaggctggtctggaactcctgacctcagatgatccacccgccttagcctcccaaagtgctgggattacaggtgtgagccactgcgcgcagctcttatctataaacttatgcttttcatttgtttgtccttttgctttttgtactgggataatttctcaatttttaagcggttgcatctcctattcagctattttttgtatcaagtattacattgttttaatttctagtaactgtagttcattcctttctttatcaatgtagtatattcacacatctctctgaatatattgaagtcttattctgtgttattaatgctatttccttggctattctgtttgccgagtttagtattttcttataatgttagttttcccttggtgtttagtgattcttagttgtgttctcttctttttcactcatgagattccttgttcatctgtctgtaagtgttttatgtaattaccgtaactttccttcagtaattgtgggaaaggtatgggacatgctccctggcactgtattttgtaacttatctctaatgctgcctggagggtggcccagtagctagtctccaaatgtaggagggcttacctttcttcctggatgtcgtctccttcctacatcgttgacctctttcttggccacaaaaccttttcctcttactgctcttatttgggggcgcatgcctctgctgccctttgcttggtctggaggtggggagagaagggacagaactgcctgcctgttccttctttgttatcccaaccagttcattcttccattcagtaaatatctctttagcagtgaataagtcaaaacctctgtttttgtggagtttacatctagtagaagaaaatggatactaaacctatatatggtagtcagggaaagacttgtatgtgatggtgacagtcataggcagagatctgttcaaggaaccaaaaggcggccagtaaacaggagagcattaagagataacattgaaagagacagaagatagatctgatagagttttgtaagcattctagcctaccactcatctttttagttggccagggttctctcctgctgcccgtatcagccactcaggtttgcagcattttgaaacaattcctacatatgtcatggtctactttttcctctgtcagtcatatatgcatgtgtctatgtatattttcctgttgtgtctgtaaatttggattgataaggaaggctagaacaaatatttaatttgccatcttgatccagttactacatattaaaattcttttctgtaatttcagtgggaccaatgtaacattttctaaattgtaatactgatttttttcttctcatgaaactaattattactagtttaaaatgagacttcagaaagtaaaaactgattgcttacaattttatttttaatatgtcctgacctgccataagtttgtgtttgtttttttgtttttttttttttgaaacaagagtttcgttcttgttgcccaggctggagtgcaatggtgcgatctcggctcattgcaacctccgcctccgggttctagctattctcctgcctcagcctcccaagtagctgggattacaggcaggcaccaccacgacaggctgattttgtatttttagtagagacggggtttcaccatgttggccagtctggtctcaaactcctgacctcaggttatctgcccacctcagcctcccaaaatgctggcattacaggcgtgagccactgcgcccagccctgccctaagtagtaataatgcttacccaagacatcatacttactgccatgtaggctatcttctttcaggcaaatgctaaatcccattctttgtgcttttatatatttttttaatcttctagattagtagtgacccttctcatgtttcccaaaatatttgtggttgtctgtgctaacttttcatattaattattataggggatttatctttaaagcactcatttagatacaacagttatatctggggcccttttgcggggagtagaaggacaagaagaggggattgattttatagccagcatagcctgacgttaacaagaatttttagagcatgattttgaagtaattttgatgtcctttataaatttccctatgctttcataaagtaagaaacttgatttcctgatacttctctgtaaatctaagtgcctagatatcttgtttttttctgtttttatgtgtttcaagcatctttaactgagtctcttaaataatataggcataaatgaaaatttccatgataatagcatggagttttagtaacctttttagtaaactggcacatatgaaggaaattttaatttgattttcagttttcaaagtttgtataatgatgaaaaatattctggggtagaagattaataatcttctcttttatttactaaagtctaaataatatttttaaagaaacaaggctttttataaattgagtactttgggttcagtctgatatgctactattaatgcaactatatacgtaatactctattttgggttaaagattagtctatacaagaaattccgtttttttttttttttaaaagcttcaccttacctaaattattaccactttggtttttctcggttgttttgttttgttttgttttgttttgttttgttttgttttgttttgtctccattaggagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaaggtagtgtgcttacagtcagggacatagactaggtaacatcacttttcatttacttattttttttgttgttcatatacaaatcttgccactttttccacatagcccatgtatgtgacatgtcccattaatgtcattgccattttattttttccttttgtaactaatttggttttccggttattcatttcatatagatactaagtcttgggataaatcttgcaatgtctgatttagacttagggacttaatacaatgttgcttattacattaacaccttttaattgtctagcaggagttaagctttttctacttttcttcatttttggtaatgtaaacaaatttagtcttaacaaacaattttctcttttttacttacaatttggcaaaacttgcagtggaaacagaagagatgagatcagcaattgctcctgatcccattcctctgacacgggagtccacagctgatactagggctttgaatagatgtaaagcgatgagtggatcatttcagcggggtcggttccaggtttgtgtctttgattgaatccttatctacaagggcattataaaatataacagccagtggagatcttggtctgtagatgatacttccatttttgtttttatttttttttgagatggagtttcactcttgttgcccagttggagtgcaatggtgtgatcttagctcactgcaacctccgtctccttggttcaagcgattttactgcctcagcctcccgagtagctgggattacaagtgcgcgccaccacacccggctaattttttgtatttttagtagaaacggggtttcaccatgttagccaggctggtcttgaactcctgacctcaggtgatccgcctgcctcggcctcccaaagtgctgggattacaagcatgagccaccatgcctggccgatgatacttactttaaatgtagatcattgtcatatttaatttgttcatcttgcatgcatcccctcaccttttgaagccatcagtaaagatgaatctaaagaaatggagattttcatagctggtagagagcacagaaataggttttcttttggcgggtgggtgggtcctcttttataaatgtaatttcacgtcctttagaatctcagcaactctaattgtggaattttatttgagcaatatgatgcccactctctttacccaaggggcctgattgaaagagtgaatttgggggtatagattaaatttttaagttttgctagtatcaatacatatacatcacagcagagcatctacttgtctgtgctatgctaaccacttttacgtttttatatctcaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaagtaaggactgtttctcttttgtcacaaatctggttgccctaggttttatagaacttagtattggattggtaactaatttaggattggtgacattttaatgattgaaaactacaaagaatgctaatgctaaacatttatgaatgagaaaaagttcttatatataaaatgttttcatagtctcaagactattacagttgcttatttaccaatatgatttaactactctttttgctaacctttacaatccttattcttcaggacttttggttttagattttacaactattcttatataatttcacatttgataagtaaacagctgatttattataatcagagatagtggttcatcttctttaggaaaaggtaagatactttcaagatcaagcttattatttggtgactgaggtaatcaaccttcactagtgatattatgataatatattttgtcaatagaatgctgttttgtatttagttttataaaataggtcatttaaaaaaaagaaattcaggccagctgggcatggtggcgcatgcctgtaatctcagcactgtgggaggcagaggcaggtgtatcacttgaggtcaggagttcaagaccggcctggccaacatggtgaaactttgtctgtatttaaaaaaaaaaaaaaaaatacaaaacttagccaggtgtggtggcagacgcctgtactcccagctacttgggaggccgaggcaggagaatcgcttaagcccaggaggtggaggttgcagtgagcccagatcgtgcgccactgcactccagcctgggtaacagagcaagactccgtctaaaaaaaaagaaaagaaattcatatttaagttgctgaattctaattctatccacatggttcaaaattcaaaaggtacaaaagggtaaccagtagtctccctcctagcactgcagctgaactatccaggttctctccttagacacaataaatattacctgtttcttgtatatccagttagtctataactgtacaaacaaatatgcatatttcattctttgttccccaaatagtaacttacactgcaagactgttcttatatcttggttttctttaccatttcatagtatcttggatatatatctgtatcattatatttttgactgtttcaaagtattccattatatgtatatactcataagttaattactagcctcctattgacgaccccatgcccttactttgaaaagttgaaaccaactctagcaatttttgaatatatcttatgctttagagaatttccacactgttctgggacttgaacaatttgtaaagcagggagaaccagggaggactaaataggcacgcaaaaagctggatttggccagacacagtggctcatgcctgtaatcccagcactttaggaggccgaggcgggtggatcacctgaggtcaggagtttgagaccaccctggccaacatggcaaaaccccgtctctactaaaaatacaaaaattagccagacgtggtggcgcgcacctgtaatcccagctactcaggaggctgaggcagggagaattgcttgaaccttggaggcagaggttgcagtgagtcgagatcgcaccactgcactccagcctgggtgacagagcgagactccatctcaaaaaataaaataaaaagctggattttagtcaagttcttacaagcttgaataatgctccacttggatgctacgttcaagtgcttcaagaattaaagcaggttaaaatccttggaaatttcttagtttctagggccttgcccagagaagaaaaaaacccaaaactgtcattccaatgatagataattataatattttctctctaacttgtttcagtgtttttaacttgagcttgcaagaaaattgtgaatatatactttaaatattcatcaccagaaggctgatattccactttaaaatatatatacaggcttgacattacattatgtatacgtcaacttatatattaagtactatacagtatatgtacactgatactttttataataaaagttattaaagcagtttcatatttgtgatataagtattctattgcttttgttttgttttggtttggtttttttggttttttttttttttgagacggagtctggctctgttgcctcagctggagtgcagtggcgtgatctcggctcactgcaagctctgcctcctgggttcacgccattctcctgcctcagcctcccaagtagctgggactataggcacccgccaccacgcctggctaattttttgtatttttagtagagacggggtttcactgtgttagctgggatgatctcaatctcctgacctcgtgatccgcctgccttagcctcccaaagtgctgggattacaggcgtgagccattgcacctggccttctattgctgtttttaatggttcttttaaaccattgtcaaatgactggtagcttttgtagctggctagttttttgtaactgggtggttatgaatatctacttaattttgaatgtgagacatggattctcataacctcatagaacccaagacctggaaaggatcttttattttgagacagagtcttactatgttacccatgctggagtgcagtggtgcagtcatggatcattgcagcctctacctcctgggctcaagccatcctcccacctcagcttcccaagtatctgggcctacagacgtgtaacacatccagctaatatttaaatttttttgtagagatgaggtctccctgtgttgcccaggctggtctcagacttctagcctcaggccatcctcctgtctcagcctcccagagtgctgggattataggcatgagacaccatgcctggcctagaagggatcttaaaagataatttattcatccttcagtgttcttttagcattatggtttcttcaccgatttttattattctttcttttattactattacaattattattattaagatgaggtcttgctctgtcacccaggctggagtgcagtggtgctgtcatggctcactgaagccttgacctctggctcaagagatctacctgcctcagcatcccgagatgcttgtactacaggcacgtgccatcatacctggctgatttttttttttttttttttcagagagacagggtctcactatgttgtctaggctggtattgaactcctgggctcaagcgatcctcctgccttagcctcccaaagtgctgggattacaggcatgagccactgcgtctggcaaaaaatgttaatattattaatactatttgactttacattttgttttactgactttcactgtatttcagttttagaaatttgttaatctttttcttcatgagtgattattacagttaaatgttatgcttaggaaggcatttcccacttcccctccggaaattgtgaaaatactctgtatttcctccttccttccttccttccttccctccctccctccctctctctctcgctctctctttctttctttttttttttttgacagggtctctctctgtcacccagtctggagtgcagtggtgtgatcttggctcactgcagccttgaatacctgggctcaagtgatcctcccacctcagccttttgagtaggtgggactacaggcatgcaccaccgtgcccagctaatttttgtatttttttttttttttttttagagagatagggtcaccctatgttacccaggcttgtctcgaacttctagtctgaaacaatactcctgcctcggcttcccaaagtgctgggattatggatgtaagccattgtgcctagtctctatttccccattcttaatctaaattccttgttaaactttacttatactggtttagagtttcttggctcatctttatggagccagtgccattaaaatgctttttgcatgattttcattcagacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacaggtaaatcagtcataaaagtaatttttaaaaaatctagtccaagattagcaaaattagtaaaatgattataatacaatttatttttaattaggctaaaataatttaaagaagtacacattattctgagattattttctgtttttgatgttaaatgtccttttatgtagtaatgattaggataattgatagattgtaaagagaagctgagtatggttcatgcttttatttggaaaaccagcagctggaagcccaatgccaatccccacaataatttttgaaatgttatcagtcagtgggaacttctggtctagcatttagagtttgttggagagtttgttggtaacaagataatcttaaaattatactcggccaggcgcagtggctcacgcctgtaatcccaacactttgggaggctgaggtgggcctgtcgcctgaggtcaggagttcgagaccagcctagctaacatggcgaaaccccatctctactaaaaatacaaaaattagctggatgtggtggcaggcgcctgtaatcccagctactcaggaggctgagatgggagaattgcttgaaccctggaagcagaggttgcagtgagccgagattgtgccattgcactccagcctgggcgacaagtgcgaaactccatctaaaatacatacatacatacatacatatatatatatatatatatatacacacacacacacacacatatacacagacacacacacacactcaacaagaatgaaactccgtctcataaaaagaaatacatacatatatatacactcatgctcttatctgaagagatctttattagttataagaatattagtaaaatatacttctttgactttgaaaaataagagcatcaatctctacttaactaatatagaagttgttaatcaggtcaggcctctttggttatatgtgcatagtcaaggtgggggttaaggatgtattgtaaggacatatgtgaaatcccaatggaacttgtcgtaggcagaataattccccccgaaaacgtccatgtgcaaatctctgaaacttgtgaccatggtaggatatatggcaaaggagaattaagcttgcagatgggattaaagttgctaatctgctgactctaagatagggagattatcctggattatccaggtaggtccagtgtaaaatcactaggatctttaaaagtagaagagaagaaacacagaagagtcagagaaaagggaaacagtgtcagaaaggtgcaacattgctggctttgaagatggaggaagagtgccacagaccaaggaatggaggcaacttctggaagctggaaaggccagggaacacatctctcctatagccttcagaaggaacacagtcctggcaacaccttgattttaggccagtgaggcccatgttaggcttgtaacctagagaactataagatcaatttgtgttgtttgaagccactaagtttgtggtaattagttacaacaacaatagacaactaatacagaacccaagaaaaggaactgtacttggatgatcttgtaaagacagaattaaggggtagacttagattgaaggcagctctggggatttaatagcagaagtacatgaaccttcagtctgatgcagtatcactaatagctatactttattttattctgtttcattcccaaatggcttcattttatgcatagtttctgctttcccaaaactgttagataacactggttactcgtgatcccaaagcattctttcactttcaggtccttatttaactgacctttgttagattccagggacagaaaatttgactgtccctgctcatctttttcatgccaagaaatgggtcagagcccattgcctggcctatagttgggctgttctacagtcaggtgtccacctgtttctaagtaagcatggccagagaagtatgatctcatggtaaaaacatgtctctggaggctgtctttgggattcctcaacttattttgtgttataatggatgtaccacagtttgtttatccattcatcggttggaggacatttgggttgtttctagtttggggttttacaaataaagctcccgtaaatagtcacatacagctttttgggtgaacataagttttcagatcacttggatgaaatacccagaaatgagattgctgcatcatatggtatgcatatttaacattttttaaaaactaacaaaccattttcccaagcagctgtatcattttacattttgtcagcaatgtgcgagacttccagtttttctgatgctcttcagcacttggtattactagcattctttttttagccaatccaataggtatttgatgatataaagtggttattttattataattttcattcccataatggttagtgatgttgagcattttttttcttgcacttatttgtgatctgtatatcctctgtggtaaagtgtttgttcaagttttttgctatttttttgtatcctgttttatttttaattgaaattttcattgagataattgtcgatttacatgcagttaaataatacagagagatgctatgtacctatgtatcctttactcagtttatcccaaaggcaacaatttttgtcattttagaaaattaggttgttggttttcatatggttgattttcgagagttttttctgtatttttgataaaaatcctttgtaggacatgtgatttagaaatatattattcaagtctatagcttgtcttttcattctcttaacagtgtcattggcagagcgaaagtttgtgattttaataaagtatactttatcaaattttttttaaaaattgtgattttggtgtaatatttaagaactctggctaaacacaggtcacaaagattttcctctatgttttctcctaaaagtttaatagttttatgtttacatttagatttatgacacatttggaattactttttgtatgaggtgtgaggttttgggtgaggttcttttttgcatattgatattcaattattacattaccatttgtggaagagaccgtcctttctccattgaatagcttttgtacctttttgaaaaatcaattagccatatatgtgtcaatctctttctggactctttattctgttccaattaatctatgtgtctgtcctttcaccaataccacactattttgattattgtagttttatagcaacttttaaaattattattgttaaaattaggtattatgtttcctgaaactttgttttttttcaaaactgttttagctactctacttcctcttccttttcatataaattttagaatcagcttgactatatctaaaaaaatcctgctgtgattttgattggaattatgttaaatctatatatcaattttggggagaattgacatttttactgtgctgagtcttccaatcaataaacgtaggctatctctccttttttttgtctttttttttaacttttattttaggctcaggggtacatatgcaggtttgttatataggcaaattgcatgtcatgggggtttggtgtacagtttatttctccaggtcttcttagatatgttttatctgctttttatagttttcagcttacagattctatatgtgtttcgatttatttatacctaaggatttattttatttctacagggtttccaatcacacattgatagagaaatatgattaatttttgtgtatcgaccttacatctgaagattttgctaaacatatttgttctagaagttttcttatagattctttgggattttttgagtgagcaattatgtcatctgcgaatatagacttttttgtttctccctttttaatctttatgccttttatttcttcttactattgtactagctaaaactttatattggacatccttgccttgttcttccaaggagaaagccttctgtcttttgccataaattataatgttaactgtaagttttcgtatatgccctttattaatttaagttcaataagtatgttggtttacagttttcatctttttgttttatattttgaaaattttgatactatctttttctggtttgatatcagggaaaagctgccttataaatgagttggaaagtaagtatttcttttgcttctttacttttaatttttttaaaaaattacagttttattgagatatttcacatatcataatgttcactcatttaacttatacaatttacagacttgtgcagctattaccacaatttgattttggaatattttcaacattccacaaagaaacatgtacatattcatagtcatccctcattgtagctcctctaccccaaacccccaaccacaggccctaggcaaccacaaatctgctttctgtttctatagatttgcctatgctgaaacattttgtatcaatacagttacacaataatatgtggtttcgtgactggcttcttttacttataatgtttttgggagtcaaacattttataacatgtatcagtacttcattttttattgctgtataatattaaaatgtatgtttatccattagaacactttcatcacctcaaaaagaaatcccttttctatgagtagtagcccccgccatttattcccacttcccccatcctccagcctcatcaatcactaaagtattttttgtctctatagatttgcctgctcttttttgggaggccaaggcaggaggattgcttgagcccaggagttggagaccagcctgggcaacaaagtgagaccccatctctataaaattagccaggcatggtggcgcacgcctgtagtcccagctactcagaaggctgagacaggaggattgcttgagcctaggaggttgaggctgcagtgatccgtgttcacgccattacactccagcctgggcaacaagcaagacctgtctcaaaaaaataaaataaaataaataaaataaaataagatttgcctactctggacagttcatgtaaatggaatcatacatcatgtggtcttttgtgacttttttcacttagcatatatttacaaagtttaactgtgttgtaacatatattggtacttcatttctttttgttgccaaataatactccattgtatggatatgccacattttattcattcatcagtgattacacatttgtgttgttttctcttttttttgctattatgaataatgctgctatgaacagttgtgttcaaatttttatgtggacatttgttttcatttctcttggatagatatgtaggagtggaattgctagatgacatgggaactctatgtttaatcttttgaggaattaccagactttttttccaaaatagctgcaccattttacagtcataacagcaggacatgagggttcaacaactcaacaataaaagattcaaaaatccaattttaaaatgggcaaaagattcaaataggcatttttctaaagaagatatatgaatgactgataaatacatgaaaagatgttctgtaatattagttattaaggaaatgtaaatcaaaggcacaatgagataaaactttacacccacttaaaatggctgaaatttaaaaaggcaattcccaaggacataggacatatgaggcgaaaaaaagaaaaaaaaatttttaagacagtagcaagtgttggagggaatgtagagaaattgttgagttgtgagtaaggactagagccttactgaatatgattttgcaaataatcatctcctattcttagattgtcttttcactttcttgatagtgtcttttgaagcacaaaaagtttttaatggttttaaaatctaatctgtttcttttcttttgttacttgtgcttttactgtcatatctaaaattccgttggctcaccattgactctatagtaattgaaaagaaagagaaaaaagaaaaaaaatctattgcctaacttaaggtcatgaagatttattcctataatttcttttgtttgtttgtttgttttgtttcgttttgagatagagtctcactccgtcgcccaggctggagtgcagtggcgcgatctcggctcactgcaacgtccgcctcccaggttcaagcgattctcctgccttagcctcctgagtagctgggacacaggcgcgtggcaccacaccccactaattttttatttttagtagagacggggtttcaccatgttggccaggctggtctcaaactcctgacctcaggtgatccgcccactttggcctcccaaagtgctgggattacaggcatgagccaccgtgcccggcctattcctatattttcttctaggagttttatagtgaatctcttacatttagttctttttttttttcttcttctttttttttttttttttttgagacagagtctcaccctgtcgcccaggctggagtgccgtggcacaatctcagctcactgtaacctccacctcccaggttcaagcgattctcctgcctcagcctcctaagtagctgggactacaggtgcatgccatcacgcctggctaatttttatatttttagtagagacagggtttcgccatgttggccaggctgatctcgaactcctgacctcaggtgttccacccgcttcggcctcccaaagtgctgggattacaggcctgagccgctgcacccggctacatttagttctttgatccattatgagttaatttgtgcatatggtgtgagttaaagatccagattcttttttttttttttttttttttttttgggtatgtggatatctccttgtcctagcactttttgttgaaaagactatttttcccccattgagttgtcttggtacccttattgaaaatcaactgaccagaaatggacagatatatttctgtaatcttaattctactccgttgatctctgtgtctggccttatgccaatcccataccatcttgattcctatagtttatcatgtgttttgaaattgtaaattgagttctctaaatttgttcttatctttcatgattgttttgactattctgggtaatttgaattttcatgtaaattttagaatcagcttgtcaatttctgaaaaaaacagttggaatttagagtattgactctatatatcaatttggggagtattgttatctttaaaatgttgtcttccaatctgtgaacatggtatgtctttctgtttattcagattgtctttaaatttctttctttctttttttttttttttttgaaacagagtctctctctgttgcccaggctggagtgcagtggcatgatctcaacttactgcaacctctgcctcctgggtttaaacaattctcatgcctcagcctcccaagtagctgggattacagacgtgcaccaccacacctggctaatttttctatttttggtagagacagggttttgccatgttggccaggctggtcttgaactcctgacctcatgtgatccacccacctcagcctcccaaagtgctgggtttacagtcgtgagccaccacgcccagccaggttgtctttaaatttctttcaacaatcatttttagtttttagtgtataagttttgtgcttattattattattattattattattttgaggcagggtctcactctgttgtccagggttgagtgtagtggcatgatcattgttcactgcagcctcaacctcctggtctcactcaagtgatctttctgcctcagactcccaagtagctgggactacaggcacatgccaccatgtcctgctattttttttttttatttgttttagagacaaggtctccttatgttgcccaggctggtcttgaactcatgtatgctaaagaaaagtatgtattctggtgttgttgggtggagcgttccatatatgtctgttaggcctctttggtttagagggctgttcaagtcttctatttctctgttgatcatctgcctagttctatcagttattaaaagtgggttatagaagtctccaactggcagggcacggtggctcacgcctgtaatcccagcactttgggaggccgaggtgggcggatcacaaggtcaggagatcaagaccctcctggctaacatggtgaaaccccatctatactaaaaatacaaaaaattagcccagtgtggtggcgggcgcctgtagtcccagctactcgggaggctgaggcaggagaatggcgtgaacccgggaggcggagcttgcagtgagccgagatcttgccactgcactccagcctgggcgacagagcgagactccatctcaaaaagaaaaaaaaaaagaagtctccaaccattgttgaatttctcccctcaattctgtcaattttgcgttgtgtattttggaacacacttgcacacatatgtaataattgttatgtcttcttaatttatatttcattttatttggctgaaggagaattattattattatttgtccagaaaactcaacagtctacatttaacccagcttaatgggaaggtgttttttttttttttttagatggagtttcgctcttgttgcccaggctggagtgcaatgacgtgatatcagctcactgcaacctctgcctcccaggttcaagcgattctcctgcctcagcctccctagtacctgggattacaggcatgtgccaccacacccagctaattttgtatttctagtagagatggggttctctatgttggtcaggctggtctcaaactcctgacctcaggtgatccgcctgcctcagcctcccaaagtgctgggattacaggcgtgagccactgcgcctggccaatgggaagttcttaagcctttgccttttccagcttggcaatgagagccagagattttggacccaggatattgcctccctagtgacagtggatctcatcctgtctgtcattgtcattggttctgatggcttccaccagcttagccaaagctcctttgtctgccaagttaatctgtgtgaaggcgacagtggtgcaagtcttcctgtggactagacatcccagtcttctcttccctttgtattttatgatgcagggcaggcaggaagacagctagctctatgagatccattgtcacgtgcagtcaccaccagctgagctttcttgttctccaccaaggtggtgacagcattaatccctgctcaaaggccttagtggagacatccctctggcaactttcttctcagtctggaccaatgatcttcttgctttgtctctggtctgtccttataggccagcttaagcagttgtgtagctatttggcagtccaaggcctaggtaaactggttatttgcaggaggcactttcagctgcttttagaagatatatagatccttgctgctgcaacctgatatagcagggccatctgacaaagtgggtgaggtccctttagggctggatgtcctgttcagtgccaaaattcttaggccttttctcaaacgggattcatcaccttcttcgcctcctgcttcctcacaatagcaggagagggggccatcttcttccacttagccttcattccttttggcattttgaatggctagaggagagattatttctgatattagtacaaccaatccagctttcttttggttactgcttgcatgccatatctttttctgttcttttactttgaatgtatttctgtctttaaatcagaattgtgtttattgttatcatatatagttaaatcatgttttttattctgtcaatctgtcttttgattggggcatttaaatcatttccatttaatgtaaggtaggatttatgcctgtcattttgttatctttgttttctatatatcttcgatttttttctttttttcctcatcctctgactctccgtattcctgccttcttttatgttaaatagatattttccaatgtagcatttaaattctattgtgtctttttttatatatatatatatatatatatattattattattattattattatactatacttttttttttttgagacagagtctcactctgtcacccaggctagagtgcagtggtgcaatctctgctgactgcaacctccacctcccgggttcaagtgattcttctgctcagcctcccaagtagttgggactacaggtgcataccaccatacctggctaatttttgtatttttagtagagacgaggttttgccacatcggccaggttggcctcaaactcctgacttcaggtgatctgcccacctcagcctcccagagtgctggaattacaggcgtgagccaccatgcccggcctattatactatacttttcatttttcttcttttttttgagacagggtctcaccctgtcacccaggctggagtgcagtggtgtgatcatagctcactataacctcaacctcccgggctcaagttatcctcccacatcagcctcctgagtagccgggaccataggcgcatgctaccatgctcagctaattaaaaaaaaaaaaatttttttttaaatacaggctctcactgtattgtccaggctggcctcgagctcctgggcttaagcaatcctcctacccagcctcccaaattgctggtattacaggtgtgagccaaagtacctggccctatattattcttttcttatatttttcagttattttcttgtggtagccacaatgagcttcttaatttaaaagcaatctagttcagtttttttgtgtgttttttgtttgttttgagacgaagttttgctcttgtcgcccaggctggagtgcaatggtgcgaccttggctcactgcaacctccgcctcccaggttcaagcgattctccttcctcagcctcctgagtggctgggattacatgtacctgccatcacgtgcagctaatttttgtatttttaatagagacagggtttcaccatattagccaggctggtctcgaactcctgacctcaggtgatccacccgcctcagcctcccaaagtgttgggattacaggcgtgagccaccacacccagtcatgtttttttgtttgtttgtttggttggttggtttttttttaagatggggtcttgctctgttgcccaggctggagttgagtggcgtgatctcagctcactgcaacttctgcctctgggttcaagcgattctcctgcctcagctacctgagtagctgggattacaggcgtgcgtcaccatgcctggctaatttttttgtatttttagtagagatggggtttcaccatgttggccagactggtctcaaactcctaacctcaggtgatccgcccgcctcggcctcccaaaatgctggattacaggtgtgagccacctcgcctggcctctagttcagtttaatactaaattaacttcaatggtacacaaaacatttctctaatatatgtgtgtgtaatacatacacacacgtattccctcacaacttctttgtactattattgttatacacattacatctttacatgttataagctcattgacacaattttatagttattgctttatgcagttgactttgaaatcaggtaggaaaagtagagttataaatacaaagtacatttatactgaatattatatttacctatgtagttctcttcagcagtgtgctttattttttcatgtggatttgagtaactatctagcattcttttatttcatcctaaaggactcactttaatatttcttgtaagttaggtcagctagcaatgaatttccagttttttattagaagtgtttctatttttattttttttccatttatggaatttgtttttaaaaaacaaggacataaaggactagcttaaattggatcaaaggctgttaaaggtcctggtacaattcaccttataaaacataaggtatgagaaagtatgcctgtgttttgtttggtgagtagaaaataagaaggaaattttggtgatttccaattcaagtgtgtcactgctgtgacagcttccagctcacagaaacatctggtattcttaataccttctattctggcccaggttaaatttctttaattatatacaacaagtagaatcctattttaataggaactctaaaatagctagctatttaaaactcttctctttattgatgcttccttttcagccataaagttgatagaaaaaatactgaaaagtacaaaattgaaaaaaaattattttgcttaataagtctattaataaagttttattttatgcaataagacacctaaaaatttgaaaggcaaaatcattcttgtaaaataaagccatttggatttagactttctagggttttgggaaataatgtaaaaaaataaagattccatttgttttgtttttgagacagggtctgaccctgtccctcaggctgaagtgtagtggtgccatcacagctcactgcagcctcgacctcctgggctcaagtgatcctcccacctcagcctcccaagtagctgggactacaggtacacactaccatgcccagctaattttttttttaatagagatggggtctccttatgttgcccaggctggtctacagcttctgagctcaagtgatctgcccacatcagcctcccaaagtgctgggattatttaggaaaggtcttattctaaaaatgcttggttcaatggaaattcagattttttagtattctttgtattccagtcatcaagaagaactagttattagaatgagcattgaaagtataaagttccttttgcatgttcccaagagttagtcatcttccatttttcaaatcttttttacaacaaatattttgcttttgatacttaacattaggtctctgaaataaagaataggtaaacaaaagagtaaatctagaggcatggctactttactgttataactggttatttccaaatctcagttgtatataccttatccacttctcccctggtatatagactagcttttatccacctttgaactctcacaactgaacagttggctcccaaaagacagtgcacagtttggtgcccttaactctattacatacttttcacaagacacacttcttttcctatagattaaaattcacctatagaaaactgttactcattttcttaaaacataacaatctccaactacatgcagagcatgatgtctatgagaaggtcaccctcttcaaggagtttatagcacagtgttatgtgtggatctccttcctttttttttttttttttttttttttttttttgggagatggagtctcgttttgttgcccaggctggcgcgatctcggctcactgcaacctccgcctcccgggttcaagtgattctcctgcctcagcctcccgagtagctgggattacaggtgcccgccactaggcctggctaatttttgtatttttagtagaaatggtaccaccatgttggccaggttggtctcgaactcctgacctcaagtgatctgcctgcttcagcctcccaaagtactgggattacaggtgtgagccaccgtgcctggccgggtctccttcatttttgaaagatttaggtgaattcttctttgatagtcttactctttcaacactttgacagtgtcatcccattgtcttttggcctgtatggtttccaatgagaagtcagctcttaattttattgaagtcccttatacatgacaagtctattttttgtcttctttaaagattttctttttgtctttgattttcatcaatttgattatgagtgtctaggtatggatctcattaaatttactttagttatagttcactgagcttcttgaatgtgtaaattaatatttgtcattcagttttggaaatttggagttattatttattctgatattttttctgcccttttctcttctatttttggaactcctattatgcatatttgtcatgcttgatggtgtccaacaggtctgtgaggctctttcacttttttaaatttttttattttttattttatctatctatcaatttatttatgagacagagtctcattttgtgaatttatttatgagacagagtctcactttgttacccaggctggtgtgaagtcgtgtgatcttggctcactgcaacctccgcttcccgggttcaagcaattctcgtgcctcagccccccaggtagctgggattacagacgcgcaccaccacacccggctaatttttgtatttttagtagaggcagggtttcaccatgttggccaggctgatctcgaactcctgacctcaagtgatctgcctgccttggcctcccatagtgctgggattacaggcgtagccaccacacccggcctctttcttttcttttcttttttttttttttttaattcttttttctttctgttcttcaaagtggatttcttcatcaacctgttttcttgttggttgattatttctttttcccactaaaatctcttaatgggcccctctatataatttttcacttcagatactgtatttttaagctctagaatttgctttttaaaaacaacttccatctctagtctctatttggtgagatattgttgtcacactttcctttaatttttttaggcatagtttccctaagtttggatatacagtttgtcccttggtatatgcggagatcagttccaggactcctgcgtatgccaaaatccacacagtcaagttccacaggtggccctgaggaatgcacatatatacaaaatgtcagccctccatatatgcaggtttcacatcccagaatactgtattttcgatccatatttggttgaaaacaatccacatataagtggacctgcacagttcaaacctgttttgttcaagggtcaactgtatttataatagctgatataaaagctttgtctactaagtccaaaatataggccccctccaggatgtttttgttgggtccccttttttcctgcatatgtcatgctttcctgtttctttgcgtgtctcttaattttgtggtgcaaactggacattttaaataatatattaaagaacttctagtatcggattcttctacccctcaagggttgttgttgtttttcttgttgctaattatttagtgattttcctggacaaattttacattccctgcagtgtatggccattgaattccctgctggattttctttttcaaagagccatggctggagtgtagtggcatgatctagttcactgcagcttcaaactcctgggctcaagcaatcctcctacctcagcttccttagtacctgggactaataggtgcatgccacaacacatggcaatttttttttttttaagagaccaagccttgctctgtcaccagactggagtgcagtggtgtgatctcggctcactgcaacctccgcctcctgggttgaagcaattcccctgcctcagccttatgagtagctgggaccacaggcacacgccaccacacccagctaattttttgtgtgtattagtagagatggggttttaccatgttggccaggatagtcttgatctcctggacctcatgatccacccgccccaaagtgctgggattacaggtgtgagccaccgcgcctggcccacatggctaattttttttttttttttttttgatggagtcttgctctgtcgcccaggctggagtgcagtggtgcaatctcagctcaatgcaagctccgcctcctgggttcatgccattctcctgcctcagcctcccaagtagctgggactacaggcgcccacgaccacacccagctaattttttgtatttttagtagagatggggtttcagcgtgttagccaggatggtctcgatctccgacctcgtgatctgcctgccttggcctcccaaagtgttgggattacaggcgtgagccaccgtgcccggcccacatggctaatttttaaaatttgtgtaaagatggggtcttgctatgttgtccaggctggtctcaaactcctggcctcaagagatcctcttgcctcagcctcccaaagttctgggattacaggcatgagccaatacacctggcctccctgttggatttgtttttatttatttatttttaatttttaagcctggtttcccaaggttcacacctgggctagtgccgtttagtgatgagccatgattggtcagaagagttcactaagtgccttgcctggatatcttttccaaagggatctctgttagagatcaaacttcagacagtttgtaagacaacctttgatttacttcctgcttgcctaggaactcaaggtcaaccagaagtgagtgattggcaccttctcctttcttaggtctttcgtgggcatgccagacttttatattgccaagaatatgttagaggttttcaaagtttcttatggtcatctagttctcccagaattcccttttaattctagtctaggttcttatttgccccaactgaaatctcagccttaggcagctgagttgttgcctgcactttcccatagtttcagtaatgccttgcaggtagccccctactctccatcccactatgctcttccactgccaggtgagcagagctttgagtgaaatcaaatctccaccacacttgggaaatagaaatctttccagggtgctgcaaaatatatatatatatatatatattttagtatttattgatcattcttgggtgtttctcggagagggggatttggcagggtcataggacaatagtggagggaaggtcagcagataaacatgtgaacaaaggtctctggttttcctaggcagagggccctgccgccttccaccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaagattatagattaacagcatcccaaggcagaagaatttttcttagtacagaacaaaatggagtctcctatgtctacttctttctacacagacacagtaacaatctgatctctttcttttccccacatttcccccttttctagtcgacaaaaccgccatcgtcatcatggcccgttctcaatgagctgttgagtacacttcccagactgggtggcggccgggcagaggggctcctcacttcccagacagggcggcggggcagaggtgctccccacatcccagacgatgggcggccgggcagagacgctcctcacttcctagacgggatgacggccgggaagaggcgctcctcacttcctagacggggtggcggccgggcagaggctgcaatctcggcactttgggaggccaaggcaggcggctgggaggtggaggttgtagcgagcggagatcacgccactgcactccagcctgggcaacattgagcactgagtgagcgagactccgtctgcaatcccggcacctcgggaggccgaggctggcagatcactcgcggtcgggagctggagaccagcccggccaacgcggggaaacccgtctccaccaaaaaatacgaaaaccagtcaggcgtggcggcgcgcgcctgcaatcccaggcactcggcaggctgaggcaggagaatcaggcagggaggttgccgtgagccaagatggcggcagtacagtccagcctgggctgggcatcagagggagaccgtgcaaagagggagagaggagacggagagagagggagagctccagggtgctgcaaaatattgactgtgcactggagatggtgtttttttttttttttttttttttgagatggagtctggctctgtctcccaggctgcagtgcactggcacagtctcggctcactgcaagctccgcctcccgggttcacaccattctcctgcctcagcctcccaggtagctgggactataggcacccgccaccacgtagtggcgtgatcttggctcactgcaagctccgcctcctgggttcacgccattttcctgcctcggcctcctgagtagctgggactacaggcgcccgccaccacgcctggctaattttttgtatttttagtagagacaggggtctcaccgtgttaaccaggatggtctcgatctcctgacctcgtgatccgcccacctcagcctcccaaagtgctgggattacaggcgtgagccaccgcgcccagcctggagatggtgtttttaagggagctcaaaaagaggtatgattgctccattgtctgcagtgctgctgtttgttggctaccacaacgctgagctggggaacaagggggaatgagaattgccccaagtcaaagtgtcacagatgccagtagtttccatagtttgtctttcatagaggtttttagttttattctatggctttggataattgtcaggggtggttggttctagttgttttgcctatatttttattgtttttgaatacaagaaagtttacccaggcccttattctgcatttttagaagtccatcttctccttccttttctattttctgaagagtttgtcttgagttagtattatttcttctttaaatgtctgggaaatttttccaatgaaaccatctgggctcagagatttcttttttgggaggtttttaacttttcaaacttttggccaggcttggtggctcacggctgtaatccaagcactttgggaggccaaggcgggaggatcatctgaggtcaggagtttgagaccagcctggccaacatggcaaaaccccgtgtctactaaaaatacaaaaattagccaggtgtggtagcggtggcacgcgcctgtaatcccagctaccagggaggctgagacaggagaagtgcttgaacccaggaggtggaggttgcagtgagctgagattgtgccactgccctccagcctgggtgacagagtgagactccatctcaaaaaaaaatttttttttcaaaaataaatcaaactcttcaatagtagttacaggattatttagattacgtatttcatgttgggtgagtttcggtagtttgtggttttgggggggacttgttccattttgtctatgctgttgaatttttgtgtttacagataatatgaacattatatttaatatctggggaatgacgtcacctttcattcctgatatttaatttgtcttctctttttttctttgtgattcttgatagaagcttatcaattttatctttacaaagatccagtatttgcttttattgatgtttttctctactgttttcccattttaaattttatggatttctgctctttattattttctgccttctacatgccttgtggttattttgatcatttttttcccctagtttttttttttttgtttgtttttttttttgagacggagtctcactctgtcgccctggctggagtgcagtggcgcgatctcggctcactgcaacctccacttcccggtttcaagcgattctcctgcctcagcctcccgagtagcagagattacaggcgcccaccacttcgcccagctaattttttgtatttttagtagagactcggtttcaccatgttgaccgggctggtcttgatcttctgaccttgtgatgcgcccacctcagcctcccaaagtgctgggattacaggtgtgagccaccgctcattatctcttatttttgtcctttaaaatcatttgggaggccgaggcagcaggattacttgagcccaggatttcaagaccacccctggcaacatagtgacaccccatatctacaaaaaatttaaaaaaaaaattagcccgtcatggtagcgcacacctgtagtcccagctacgcaggaggctgaggtaggaggattgcttgatcctgggaggttgagacttcagtgaacagttattgttattgcaccactgcactccatcctgggtgacggagtgagaccctttttcacaaaaaagaaaccaagatttgagtgcttgaggtatcattgcttctaggccctcttagctgataaggaactatacatgtgtatactaacatatatatacacacacatatccctacctatgaatatttctatatgtaatcatctgtatttatattaaggtaaatttgcattcatattgatgtctccaactctaatccattaccacatggatcattctgcccttatcgacttatctatttgcttatctgtaacctcccactccagaagtgagaaacctggctcccaccatcctccagccatttacttgtttaattccagtgtacaggtatcgtagtttcagaattttaacccaaaccctagtgggaaatacttttataaagtaaaatacaatgcttatgtacagtttcttttgccttcagtattacaggtgccactcatttccaaagttatatatagttcagcatctgttcttttacccgcttatatgaggttgcttcatacattttcaatatgattagatgctttcatcaaattctacattcccttctgggattccctgacctcctaaattgctttttaaacttgcatatattaaggttcattctttgtgccttttctgtgcattttgacaaatacattctatcctgggatctcatgacctcctaaatgatttttttttttacctttgcatacattgaagtttattctttgtactccagtattccctaggttttgatatattatattttctttgttgttgttgttcttgagacggagtctcgctctgtcccacaggctggagtgcagtagcgtgatctccattcactgcaagctctgcctcccggtttcacgacattctcctgcctcagcctcccgagtagctgggactacaggcacccaccaccatgctcggctaattttttgtatttttagtagagacggcatttcactgtgttagccaggatggtctccatctcctgacctcatgatccgcccgcctcaacctcccaaagtgctgggattacaggcgtaagccacagcacccggccctatattttcttttttttttgagttctaaatgttttctaatttcccttgagacttcctcttttatccatggattattggtagtgtgttgtttaattttgaagagtttggagatttttctcattgtctctttttttttgaggcagagtctcgtcctgtcacccaggctggagtgcaggggcgcaatcttggctcactgctacctccgcctcccgggctcaagcgattgattctcttgcatcagccttccgagtagctggggctacaggcgcccgccaccacgcccggctaatttttgtatttttagtagagacgatgtttcaccatattggccaggcttgtcttgatttcctgaccttgtgatcctcccgcctcagcctcccaaagtgctgggattacaggtgtgtgccaccactcattatctcttatttttgtactttaaaatcattatggttagagaacatccagtcagtctgagatatgtggagtttttttttttttttttgagacagagtctagctctgttcccaaggctggagcgcagtggcatgatcttgactcactgcaacctctgcctcccaggttcaagcgatcctcccacctcagtctcccgagtagcttggattacaggcacgcatcaccacacctggctaatttttctatttttagtagagacaggatttcaccatgttggccaggatggtctcgaattcctgacctcaggtgatccacctgccttggcctcccaaagtgctgggattacaggtgtgagccaccacgctcagcctgacatgtggagaatttatcaagtccctatggctatctcacttctcagatctccctgttaacctcaggctaatggagtacctgcttctaaagttctaaatcaagtgaatcccctatggtagcagcaacagcagccaaacttactgttttctcagaatgccccactttgctgggcaacagagctgggtgggggtgatgggaacagccttgtgcaaaaacaccacagattgcacagttcttacctgaaaagttcagtagttttcacgaataaatgcttctgattttgttgtattccttaggacaaattctggagtactaaagtgattgtttttgaattttgtccaattttaggattccttttgagggaggtttcttaacgtcctcactctgtcatactggaagccagaaattattttttttcagtaggcaggaaggagagtatctgattattgtacttctgttaaattaacttatttattaaaatatttagatgggttccaaaccagactttgttatttatctatttattttttagagacagggtcttgctttgtcacccaggctagagtacagtggctcagtcatagctcactgtaacctcaaactcttgggctcaagcaatcctcctgcctcagcctcccaagtagccaggactataggcgtgtgccactgtgcctggcaaatcttttttaaaattttttttgtagagatggggtcttgctatgttgcccaggctgatttcaaactcctgacctcaagcaatcctcccacctctgcctccagagtcattgggattacaggcgtgagccactatgtcaggccctcgaaccagatttaatataaaaatggtcatgtcttcttaagtaggaactaaattatcttcattttctttttctttttataactcatggaggccaagttcacaaagacaggatgctccacatgtaccttccagtagttttgttaccttattgcctctcacaggaacaggtgatttcatatttctagctccaatagtgctctttcaaaacttgctgacatttcatctttttcccatttggccaagattggtggacacatttgttggccttagcacagcatttcataagttgtcagcagggagttaataggtgttacatggtcaaatgcgaaatgtggtattaaataatataaataccagtctctccactgtagaatttcttaggtcctttaatgtgctaatatgaattgagaatgtccaagaaaggaaataatatacaaaatctcccaaaacaattttaccagggaacccattttaggaagcagtgcttggccaggtgcggtggctcatgcttgtaatcccaacacttggggaggctgaggtgagcagatcacctgaggttaggagttcgagaccagcttggccatcatggcaaaaccctgtctctactaaaaatacaaaaactagccagacgtggtggcagacacctgtaatcccacctacttgggaggctcaggcaggagaatagcttaaatccaggaggcggaggttgcagtgagctgagatcacgccactgcactccagcctgggtgacagagcaagactccatctcaaaaaaaaaaaaaaaaaaaaaaagcactgcttaacacgtatatatccttccctgcccacaattatacatgttttgttggaaacatgagttgatacatggtattgctatgtttatttatttatttatttatttatttatttattttttagacagagtctcactctgtcacccaggctggggtgcagtggtgtggtctcggcccactgcaacttctgcctcccaggttcaagtgattctcctgcctcagcctcccgagtagctgggattacaggtgcgcaccaacacgcctggctaattatggtattgcaatgtaatggtatccacaatgtatgtgtgtagttaacttataatatgagcattgtagtaaactgtacagaatagagccaacctaacagacatgagactgctatctttagacaggcctgctggcaagattggcccttggctggtatgtgggaacttggtttccctctgttccctaaccggtaaatagttcagtttgcctggtttgttggtacaaataatgtgatttatcctgaacacatgttttcctcctcagagtctggaattttagtacgtgcctctgagaccagcccccagtgaaaaccatggtcactaagtctctaatgggctttcctgggtagaaatgtgtacacctgttgctgtatttttttgttgctggagaaaggatagggagagaacatatggaagtctgagcatgaatttctctagactcctgtcttttccctttgctgaccgtaatgtgtatctttcactgtaataaaccttagctatgaatacaactatatcttgagtccttggagacctggtgaatcactgaatgtgtgggtggtctgggagatcccaagacataataaaaatattgcatgtgttaggctgggcgtgtggctcatgcctgtactcccagcactttgggaggccaaggcaggcagatcacttgagctcaggagtttgagaccagcctgggcaatatgtcgaaaccccatctctacaaaacatacaaaaattagttgggcatggtggcacacgcctgtaatcacagctactcagaaggctgaggtgggaggattgcttgagtccaggagtgtgacagagccagaccctgtctaaaaaggtatatattgggccgggcgcggtggctcacacctgtaatcctagcactttgggaggccgaggcgggtggatcacgaggtcaggagattgagaccatcctggctaacacagtgaaaccccgtctctactaaaaatacaaaaacttagctgggcgtggtggcgggcacctgtagtcccagctacttgggaggctgaggcaggagaatggcatgaacccgggaggcggagcttgcagtgagctgagatcgcgccactgcactgcagcctgggcgacagagcaagattccatctcaaaaaaacatatatagtatatattatatatattatcttaatcctcagaacatctctgtaaggtagataaatattaatgtttgtcttttttaggtgaagagactgaggttagtgaggttaagtaacttcttttggatctcagttaataggtgagagaatccaaatctgtctgacttcaaagccttggcttttaactattatactgcattgcttcccaaaaccataaattttacctgtagtgggttgaggggaatgaatgatgatagtggtctgagaatgcttcacgcagaagataggatttgagttggtctcaaaggataaatgggctggccaggtgtgcagtggctcacgcctgtaatcccagcactttgggaggctggggcgggtggatcacctgaggtcaggagtttgagaccagcctgaccaacatggtgataccccatctctactaaaaatgcaaaggatagccgggtgtggtggtgcacacctgtaatcccagctactcgggaggctgaggcaggagaattgcctgaatctgggaagcggaggttgcagtgagccgagatcatgccattacactccaggctgggcaacaagagcaaaactccatctcaaaaaaaaaaaaaaaaaaaaagataaatgggcagaattgaaattaagggaagtggaaagagtattgtcaatagatagaatttcatgatattaaggcatgcaaacggtaaaaatgcaagatttgcaagaaagacatgtaactttcaaatagttgggtgaaatggaggatttacagtagaaagttttccttctgtacttaaaaaaatttggcagctgccacagcatgtttctgttagtgtttagtgtaagataatgaatctgatctaaaacaattatatatttaagcttaataagtgatacatgttagtttaaggataataaataaaataatgtacttgttctgcaaggacaaccatgatttcccaggtctttgccacctaaacaagtgggaaccctcatgctgttagcagtaaagaactgttgaagctttttttttttttaagcagcattttatctgaaaacagcatttcactcatattattttttacttatttattctttctgagacacggtcttgctctgttgcccaggctggagtgcagtggcaggatcttggctcactgcaatctccgcctcccaggttcaagcaattctcctgcctcagcctccaattagctgggattacaggtgtgcaccaccatccccagctaatttttgtatttttagtagagacagggtttaaccatgttggtcaggctggtgtcgaacttctgacctcatgtgatccagccacctcggcctcccaaagtgctgggattacaggcatgagccaccgtgcccagccttcactcatattaatctggtggtagtttgaagaatatattggctagagccaaggagtgagtccatttagatcactgcaatcatagtagtctatgcatgagataattaagagcttatagaatggtagaaatgaaagtggacaagagacattgtataggaggaatttcatgacgtagtgatggactggagatttgtgtattggtggggagatccaaaggatctgagtttgagtggtttggaaaaaaatgcagtatcttaaacagaagtatgacatttaagcaaatcgtcatgccaggattgtgataggtttgaccccaggtatattgacttgaattatttattttttaatttaatttttttagagacagggtctcactgtcacccaggtaggaatgcagtagcgtgatcatagttcaccataaccctgcactcctgggctcaatcaagcctcccaccttaacctcccaagtagctgggactactggtgtgtgccaccatgcccagcaaattttttttgagacgagatcctcctatgttgcccaggctggtcttgaactcctggcctcaagcaatcctcctgtgtcagcctcctaaagtactaggattacagatgggagtcaccatgcctggcctgaattgaataatttattaacatccaagtagaaaaatacatttgggaattggttgtgagattgtgattgaagagagaaatcaaggtataggataagagatagaaataatgcagtggagtgatcactgaaactgtctgaatataggcatcaccttggaggaaagaacaaaaaagaacatcaaggactgaactctggttttattcatttcatcaataagaaatgaatattaaagagcacatttgaagttaatatgttattactacctatcataaaccacgtttgcatagtacttattttaatgtgcattgattgggtattttctggcttgtgagctttgaattaagtggtcttttatattatgatatgaataacttttaaatgaaatcagtaaataaatgatcctgctttatgtaaagcatagatactgaataacattcaaatagcatttttttccttttcatatggcacattgttcttcataactttgtgtgtgtttgtgtgtgtatgtgtgtgtgtagttgttctttctgttgcctgcttaagagacacggtcttgctttgtcgcccaggctggagtgcagtggttgttgccctagtccctgtttcatttaaatacttgcttcagtttgttaattattttttcctccacttgttggctattgtgccactagttcagcagccttaatttactgccaattgagtatttaagataacttgttagaccagagttatacacaagaagagtcctaacattttatttcccttagtggagaaatgttcttttttcatttctcttctttttctccctcccacccagaaatgttcttttttttgttgtttgtttgtttggttggttggttggttggttggttggttggttggtttggttttgtgtgtgtgtgtgtgtggaatctcactctgtctcccaggctggagtgcagtagcgtgatctcggctcactgcagcctccaccacccaggttcaagcaattctcctgcctcagcctcctgagtagctgggattacaggcacccactaccatggccagctaattttgtatttttggtagagacggggtttcaccatgttggccaagctgctctcaaactcctgacctcaggtgatccacctaccttggcctcccagaatgattggattacaggcgtgagccactgtgccagccccagaaatgttcttaaattaatgacatttagacctaacctctctgcaacaaatgctttagaagctgaagggattgggcacaaaaatatttctaagagaagacggataggcaaaactgtgggcattgatacattcctgtttctggctatcttctctttttaattctacctgctgacattcttctaggttgagaacacagtctataaaagcttaggctctaaagtcttccccaactttgttgtgctctttgctccctcgctggaataagcagagaattagttgaatgtgcaaagggataacaagaagaaatgatacttttattatagactgacttttgtgtctcaggattttatgtcttagaaaaattgggattccaacaagttagtatgtcattttgatatatcatggttgccccaaattagtaaatgttgttttaaaactcttgtatatgtgaatgttctgattaattcattaaactcttcttatacaacactactgtgtttccctttgatatttaaggctgggtgcagtggctcacacctgtaatctcagcactttgggaggctgaggcaggcagatcacttgaggtcagaagtttgagaccagcctggcaacatggtgaaaccccatctctaccaaaaatacaaaaattagccgggcgtggtggtgtgcgccttgattccagctactcgggaggctgaggtgtgagaatcgcttgaacccaggaggcagaggttgtagtgagccaagatcgcgccactgcactccagcttgggtgacaaagcgagactctgtctcaaaaacaaacaaaaatatttaatcacctttgaatctaaattttcagtagcacagggttcatagaaaatcacagactatgcatatgcaatcattgagattgtcatgtttccctttattaagtaatatcttcttccatttcctactttattatatcagttggcatttattttattgtattattattattctttgagacagagtcttgctctgttgcccaggctggagtacaatggcgtgatctcggtacactgcaacctccgcctccctggttcaagcgattctcttgcctcaaccttccgagtagctgggattacaggcgcacacccccacgcctggctaatttttgtatttttagtagagacggggtttcatcatgttggccaggcaggtcttgaactcctgacctcaggtgatccgcccacctcagcagttggcatttatgatggagtacaacggaaagcccactgaactgacagtcaggatatctggattctagccccagcatatgacgccagttgttaatcttctgggtcccagttttactgtctataaaacagaatgacacttgtttatatcacaggcctgttataagtttcaaaaagtattaatatggaagcttcttgcattacctcttgcaattttttttgtattttttcatgattaaaagaagtaccataacacatgtataaggcatcttcacatgcttgttaaatccctggaactgttattgtgcttaaatttacaactgtatttcctaaaattaattttagaaccactctgtaagtttttggcttataattcagtcagaggaattggaactctatgaatatttcctgtaagaatgatatcataagcatgagtaatagtactcaattatcatgtaaagacttagtgtgatgttcagattaggaaagtatacttatggaattctctgtaattgatttctttcatttatttgaacatcttatgctccacaactcatgaggctcatcaaaccatctgtgtcttcatttctgctattctagatacacattcatctttttaaatcgtaaacagaaatatcggtaaaaaataaaatgagattctagttttctgaagcttcttaaaagtcagtatggtacattgaaaagatagagtgtctttgtctaggctttagagttccaggcctgtctctgctggtaattagttgcaagaacttgggcatgtcagtttacttattctgggccttgttttcccattataaaagtggcttgcactagacctttttttttttgtttttaacattatttgattcttttttaatctttaaagtatctatctgagggagctggtgaaaagattagagtttatactaatttttatgagtactatttattacccttgatttatacctaaggtaaccatataatttgctgtccaaacaagaggaaacttttttttttttttcttgagacggagtcttgctctgtcccaggctggagtgcaatggtgtgatctcagctcactgcaacctccgcctcccgggttcaagctattctcctgcctcagcctctcgagtagctgggattacaggcgtccaccaccatgcctggctaatttttgtatttttagtagagacagggtttcaccatgttggccaggctggtcttgaactcctgacctcgtgatccacccgcctcggcctcccaaagtgttgagattacaggtgtgagccactgcgcccagccaagaggaaacttttgagagtgaaagggagtactgttagcaattactccaggacaacagctttaaaccaggacgacgcaggtaaactagagtgtgtgttcaccctaattgcaccccatgtgtggctctgttaactgctttgttggccaaagagttatctgattatcagttttaattctttttcatggtttccctgttgttgttttttttgtcttatagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaagtaagttgtttatacccaattcactttgtttacaagaactaaaaccataaaaattgatgcgcttaggcctatagttacagtcactatgagagagtagtatgacttgataacatagagacttttatccttttttagattcattatgtctttgagcaaattatattttagaccatgagtcagtaaacttttggggggaaggagccagttagttaatattttaggcttttcaagctatactattacaactacttaactctgttatagtgcaaaagcagccatagagaatatgtaaccaaatgggcatggctttgttccattaaaaccttatttacaaaaagaggtggtgggctgtggtttgccgacccttgttttagactgttctatttttttaaaaaaatccagcaagtatcaaagaagaaagcgtctggaatgaaggttaattcagtccagtgtttcaagaagagtttgggttttaaggaaaagttttcctgtgtttcacgtcaatattcttagatctgataagttatttgttcattatgaaaaagaactttaaagttatttaaactggaatattataagaggtgttttaaagaaaagatgcctagttattgcatgtggccttagtcaggtgtacatgcaatgaagtgaagaaagatgcccacaatgcattctggagtaggaagaagtcaggcttacagaacagcacacatagtataatataatttatgcaaaattatatacattagatatgcatagagaaatatgaaaagccatgaaaaatatgctggatggtggaatttgggccttattctactttgtacatttctgtgtttttgtatttttaaagtaagtgacttttttttcaaaatgagtaaacctattaaaatggaatcagggcttataattttaaccctcttaattgaaagagatttatctctgtgtgttacatttgtgtacatgtattgtcatatgtgtacatgtatagtcatatagtttgttaaagaaataatgcatttattgttaatattgaataaaaattttcaaaatcctcgatttcccaagctagtgagcagtatatctccttgggagctctgtgtatttatcttacttgtggcaccaatttatacacagatagcatcaccattgtaaaaattggaagcctttagaggcaaatttcaagacataaatgcatttgtactgccagtgagagaacctctgagtactgtgtgaatggaggcttttgttgactagttggagggctgtttactggagtataatggaggatgtttggaggaagggtgagtagaaaatggtgtgtgaataaaagtaatgaacgtcatttaacagacttgggttccaatgtcagctcagtcacttactagttgtgtgactttagaaaagtcatttgatctatctgtgcctcagttttcatgtctttcaaacagaatacctgccttacaggattgctgtgaggattaaatgagataacacctataaagctgtacctttataggtgttacatagtaggtaccctatatctagtaactatttttgtatttgtaggttcagttggttatatcttttgtgtggcaagcccatctcactaatgctcttacattgtattgctctgtatccttactcagaaatacttgtttgcttaacagttatgtaccaagccctctgttagacatgggtttggtgagtaaaaacaagtatgatccctatcctcatggaatttatgctctgctaagacagctagttagacataacagaattgcatatacgaatataaaattgcaaccgtaataagaactacaaaagaaagatataggctataatacgggaaatttgacctagtaaaggaaagtcaaggaaagcttcactgagaaagtgatgattaagcagagatctgaaggatgagtaggtgttaactaggtgaaaagaggaaatgattccatgcggaaaggatcgcatacgcaaaagccctgtatgaggaaaggagcgtgaagggattgaaagtaggccagtttggctgaagtgaagagagcaaagaggagttagtgcacaatggatctaaggtagatggagtcttaaaagtggtaatgataaggaacttcatctgtattttttgttagtttgtttgtttttattttttttgagacggagtttcactcttgttgcccaggctggagtgcaatggcgcgatctctgctcactgcagcctatgcctcccaggttcaacaattctgctgcctcagcctcctgagtagccgagattacaggcgctcgcgaccatacctggctaatttttgagtttttagtagagacagggtttcaccatgttggccaggctggtcttgaactcctgacctcagctgatccacccgccttggcctcccaaagtgctgggattacaggcgtgagccaccgcgcccagccgtctgtatttgaagaaagataaatagccatttaagccctagggttgacatgatcagacttgttttttgaaaaaatgactctgactcaagcaagagaaaaggattatttattggaggtaagggtagatgttggcagaccagttaagagttagtcatggtaactcttaactggtctggaaaatgggagaagttgagttgaacagaagtgaacagattccaaaaaatgcttaagagattaaatggacaagatttggtgatggaatggatgtatggtgaaggggaggtattaaggctaggtttctggctcccataactggatgctattctagtgtaccaatcaccgagatgcggaatgtgagcagacagtgtgctttggtaggggaagatcacacatttgatttctaggcatttgtttctgagatgcctttgaaatatccaggagaaaatgtataacctctccaatttgtctttttttaaaaatcaggttatctataaactaataatgttcattatataatttaatcagtgcagaaaagtacaaaatttaaaatatcaccttcaaatcccaccacccagaaataattttcattaactttagataaacatcatgtcaaatatctttctatgtatgtatgcatggaaataactataaaaatgtaaggcagggcagttatgaagatggcattaattaaggtacataattatggttagcacacagaaaggtgctccaaaaatggtagtccctaatagtaacaataggaatagtatgccaaaaagactaggaaggaatattcatttgtgcagcagcaatagaaaaaaaaagaataggaaggaatatagactgataaaagtctataccaaataaactgatcttttgtttttatttttgtttttcttagaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatg

SEQ ID NO: 3420 - DNA, 165180 bp, human
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggtgagggtcccgggccggccggggcgctaggagagagggaggaggccggggggcgtgtctgggatcgggctgagagatgaatgggccagggatgaatggagggaggcagcggcggccaagagtctgttaggagtaagcgccctagcggggggcggcttgaccgaagcagggtgagtgccttcaccagtcggtaccggacgaggccgggctccgggctaaggggctgtcgaaactgctgaataggcggagaggaaaatgaacagggggaaagtggggaagggcaggtttgaggctgaggtgcgttttttgttttgttttcttttttgtttttgattttttttttggttgttgttgaggggtgacaactttgggagctgatggaagaccaggggacggggaaggtgaggaggatacaggagggggacaggagacggttgacaaaggactgagtgatcacttaagtgagattgaagctactgaaagggaagatcgcttcgggtgtgggaagttcagttgtattgatgggaataggatgaaggaaagagtagatttatttcagaggttcagctgatgtgtgagggacaggatggggtgagaaatattgctggcttgtgtaaatgtgttaggctcaaggagattctgaggtgttatttgggaaggggtggtgtgtgttgtgtgactgacaggttggggatggggaggagatggtatgataggtgaggatgaaagtggtgaggtggcttcactgtactgaaagaggttttgtttgactagttaaaagtggtgaaacatttatataatggggtgggggtggaaatcctgcacgtgagtatctccgtatcttgggggttgagagactgttaaaatgagactgaaccctcaaaacagatgcgaatagtatggctattttttcttaagagttactgttgattgagacaattatatgaataaaacagcttttgagttgtgaaaatcttctgcatagtagtgattgtatccaatttttggagataccgttatctgtttttcatctatagtaagttgtaataccaagagaacttttgaagaggtcttagtatgtgacagagcagcgggtgtcttttaagacggtctctatcctttggattgatgagtttaaaaattgtttaaactcgacagctcaagggaaagataccttgcattaaaggatagcaaaaatgcactaaagcttagccgggcgtggtggagcgtgcctgtaatcccagctacttgggaggctgaggcagaagaatctcttgaacctgggaggcagaggttgcagctagccaagattgtgccactgcactctagcctgggcgacagagcgagactctgtcttaaaaaatccactaaagctgactttgaactaaaataattgtacattttttttggtcattacgaatttatctttgaaaattggcactcgctttttggtgtgagtttaaattacaacagattacgtgaacattttgttctctgaatacttatcttctgataaggatgtcttgtcctggtctcattctgttctgggtcaagattaacggttatggattttaatcttttgtgattattttttacacattttactgatatatatttagttttcttggaaatgttgcaaacttgagaacattcccatgctgtttttcttttattctgctttgatattggaaagagtgtaatccttgtttaggctacccgcagtttgaatacaaaaggtcatattctgttcatagtctctcagattgagatgaatacttaatgtattaaatagtacagtagaagtataaaggcactgtaagagcctggaaatgttgcactaactcaaccaggcaaggcggcctcccagttttgaactagatgtttctagatgaaggacattcacattttgggtcttgaaagtgtaagcatggtatatttggagaatggaatgagataaggctggaatcttaggttgaggctggggtgaattaggaactcttgattgtttaagaaggggaataacataaacagatttatggtgtttctctctctgcctttgcttctgatgtccccctctacctggaatgctctctctccccctcccctagaatttgaactcattcttttaaaacttaacatttgtcaccagctattcctgaaagcctttcctggtttccctttcttccttttcccagcatcctccaccaagctaggttaggtccccctctttagagttctatcataccttgtacataattttattacggtactttggttgggaggcaggtaggaaaggtatttttctccttctatctgaaaaagaaatgaagcccagaaaaacaagacatgccctagtaagtggtgaaccccggagttctgacttctagaccattgttgatcttcatatcacaagtttacatttgcttaaataattatagttttaggagttagatttctgtagtgttgacttaactttcttccatagagttttgtttttactatattgttcattgctgagccggtaaatgataaagccagtggctgcaaagaaccagagtaggcagaagtaaagaaaataatggatattattattattattttttagagggagtctcgctctgtcacccaggctggagtgcagtggcgtgatcttggcttactgcaacctccgcctcccaggttcaagcaattctcctgcctcagcctccctagtagctgggattacaggcacgtggcaccatgcctggcttatttttgtatttttagtagagatggggttgccccatgttggccaggctggtctcaaactcctgacctcaagtgatccgcccgcctcggcctcccaaagtgctgggattacaggcatgggcccgctatcagatttctagtcagataattgaaataaaaataattaacagagggcctaattttttttatttttaaataatacttattagcatatttaactgatttttaaaaaaataattattttattattttttaagttccggggtacatgtgcaggatgtgcaggtttgtcacacagataaacgcgtgccatggtggtttgctgcacctatcaacccatcacccagctattaagcccagcatgagttggctcttttccctagtactctcccctccttccgcctccctgacaggccacagttaactgttgttcctggagggcttaaattttttgtgtatgttttcgtggggaaggaattgtgtataaggaaaaaaacccctcctttctcagtctctcaatataagtagaccagctctatttacagatatactcgattttgtctcttggccaaaagccagaattctttcaaacgagtgggtcttttccacctttgtttgagatcataacatttatgatgccgttaggagatatttgatgactgaaagacatctataagacattcattcagaaattttaaagctttaaaagtagaattgatacaatttttaattgttttgatagagcttgttatgagatttggtttggcaaatgttgagattgactcactacagaaatgagctttgatgccctttcagggatatatttttctcgtgaatcttttttttttttttgagacagagttttgctctgtcacccaggctggagtgcagtggtgcgatctcagctcactgcaacctctgcctcccaggttcaagctattctcctgcctcactcagcctcccgaggaactgggattataggtgcatgccaccacgcctggctaatttttgtatttttggtatagatggggtttcaccatattggccaggctggtctcgaactcttgaccttgtgatccaccttcctcggcctcccaaagtgctgggattacaggtgtgagccactgtgcctggctgaaagaaatgaagtacattgttttctgtgttttagcatggtaactttttttttttgagagggagtctccctctgtcacccaggctggagtgcaatggtgcgatctcagctcactgcaacctctgcctcctgagttcaaatgattctcctgccttagcctcccgagtagctggaataacaggtgcccgccactacgcccggctaatttttgtatttttagaagagacggggtttcacaatgttagccaggctggtagcatagtaacttttaaaaattgtgataaaattcatgtaatacaaacttaccattttaaccattttattttattttattttatttatttggagatggagtctctctctgtcacccaggctggagtgcaatggcacgatcttggctcactgtaacctctgcctcctgtgttcaagtgattctcctgcctcagcatcccgaatagctgggattacaggcatgcaccaccatgcctggctaatttttgtattttagtagagacagggtttctccatgttggtcaggctggtctccaactcctgacctcaggtgatccgcctgtcttgacttcccaaagagctgggattacaagtatgagccactgcgcctggccccattttaaccattttaaagtgtacagttgtacagtggcattaggtaacttcacaatgttgtgcagctaacaccacctcaaaaggaaattctgttcccagtaagcagtcactccccattgtcccttcctccaagtcccaggtgaccattaatgtttgtctattctgcatatttcacataaatggaatcatataatatatgaccttttgtgtctggctttcactcagcatgtttttgagattcatctgtgttatggcatgtaacattactttattcctttttatggctgagtattattcctttgtatggatataccgtattttgtttatccatttatcagttcatagatatttgggatgtttccaccttttggcttttgtgaatagtgctgctatgaatatttgtatacaagtttttgtttgaatacctgttttcatttattttgggtatacctaggagcgcaactgctaggtcatatataatcctatgttatgttttgttttgagacagggctctgttgcccaggctggagtacagtggcatgatcatggcttagtgcagtttcaaccacccaggctgaggcaatcttcccacctcagcctcctgagtagctgggactataggtgtgtgtcaccacgccccacaccaggctaattttttacatttggtagagacaaggtctccctgtgttgcctgggctggtcataaactcctgagctcaagtgatcctcctgccttagcctctcaaagtatgggggttacaggcatgaaccactgtgcctggccctatgtttaacttgttgagaaaccaccaaaccgttttccatagcagttgcaccaattttcattgccatcagccatgtatgagggttccatttctccacatcctcaccaacacttgttgctttctgttttttacttgttttttaaaaaattatttttatttatttttctttctaaatagccatcataatggtatgaactggtatctcattgtggttttgaattgtatttccctaatgatgttgggcatcttctcatggcgtgttgactatttgtatttcttctttggagagatgtctatttaagttctttgctcattaaaaaatttggttgtttgtctttttattgttgagttttaagagttttttaaaaaatatacagtctagatactagaccctaatcagatatgtgatttgcaaagtttcttccattccatgaattgtctttctgctttattttattgttttgttttgttttgtttttgagatgcagtctcactctgtcacccaggctggagtgcagtggtgagatctcggctcactgcaacatccacctcccaggttcaagcaattcttgtgcctcagcctcccgagttgctgggactacaggtgcgtgccaccacgcccaactagtttttgtatttttggtagaggtggggttttgccatgttagccaggctggtctcgaactcctgacctcagatgatccacccgccttggcctcccaaaggtctagaattacagacgtgagccactgcacccagccagtattttattttattgtaaaaatagagataaggtcttgctatgttgcccaagctggtctcaaactcctgagcttaagtgatcctcccgcctcagcctcccaaagtgttgggattacaggtatgagccaccgcacctggcctttttaactgactcttttgtacagattgttaatgggcaactcttctttaaaggattaaagtaatatagcattagattaaaacgccttttaacccaacttcctgtcctcccatagataaccatttgttaagagttggttccatggttgccaaaataaggatgaaagaaaaaaaaaaaagagttggttgtggaatagttatagtccttttttctctgtatttgcatgcatatgtttgtacatatacaaataacaagtatgtgatatatattttatgacttttctcccgaagagtgtcacttagggctcttttcatatcagtatttatatgttcacttcattctttttgattgatacatagtatttcttcctgtgtgcttctctagctttgactactagggtcagtttagagtatgtctttctagccttttttatatgcattcacccatatatgagtacatttagaaatacatagttttgtgggtttttttttaacacaaatagtatgtagatgtaatatacatgttgtactacaacttacttttctcaccttatagtatatatatgtaggagatttttatatatcagtatatatccatcttgcattttttaaacagatgcttattatttcacagtatggacgtaccatgtttatttcagcattctcctatagatggatatttaagttcttttcaggttgattttgtttgtttgtttgttttgctatttaaaacaatgtttcagtttaaaaaagccctgtacctacatatttgttcacatgcaggaatatttctcaagtgatactactaaggattggaattgctgggtgacagttatgcactagatacttggaatttgccctatgaaaaggctattccagtttagctgccaacaatgcatggaataccaaatttcttatacaattctcaaacttaacagatatttattttttgcatcctgatagatgaaaaatggtactgaatcatttgagtttgtacccctctgtttactaatgagtttgagtaatccccttaccatacatgtattggccacttgtacttacttttcttttttttttttttgagacagagtctcattctgtcacccaggctggagtgcagtggcacagtctcggctcactgcaagctccacctcgtgggttcacgccgttctcctgcctcagcctcccgagtagctgggactataggtgcccgccaccacgcctggctaacttttttgtatttttagtagagacggggtttcaccatgttagccaggatggtcttgatctcctgacctcgtgatcagcctgcctcagcctcccaaagtgctgggattacaggcgtgagccaccgcacctggcctatgtttagcttttaagtccacatggaatttatttttgtgactggtttttggtagggctttagcttaccactcctcaaaattgataaccagttatcccaacacaacttattatactacctgttcttcacaaatttgaaatgccatttttaccatagactgcattcctatacatacatgtgtttgtttctgtactagttctatttcattagttcatttgtctattttaaattaaattttttattttttaaaggtgggatcttgttctcttgactaggctggagtgcagtggcatggtcatagttcactgcagccttcaactcctaaggctcacaagattctcctggcctagtgtcccatgccaccatgccagctaagctaatttgtctgtttctgtgctaaaaccacattgtttaacttactataactatatgttactatctggtaaggcaagttcttgttgttctttatcaagattttcttggctttccttctactctttagaggatcagcttgtcagtttcagacaaaaacatctctttgggattttgattgaaattgcattgattttggaataatagtggggggaggggaattgtgaagatgttgatattgggtctttccatcaaggaacatggtgtagtttgtgtatttcagtaaaatttcatggttttctttatgtaggtgttgtatatttcttcttgagtttgttcctagactagtattttatagctttgttgctcttatgaacaggataattgtttttgtttgtttgtttgtttgtttgtttttgagatggagtcttgctctgtcacccaggctggagtgcagtggcacgatctcggctcactgcaacctccgcctccctggttcaagcaattttcctgcctcagtctcctgagtagctgggactgcaggcgtgcgccaccatgcctggctaatttttttgtatttttagtggagacggggttttgccatgttggccaggctggccttgagctcctgacctcaggtgatccacctgtctgggcctcccaacgtgctgggattacaggcatgagccactgtgcctggtcgatagttgttttttcaaattacattttgtaatgattactgagatatatggcagatttctgtatgttgattttgtctttggcctgtttgctgaactcttgttagttccttgttagttatagttttttagttgattttcttggattttctagatagataatcatgtagtctgcaagttttgagttttgtctcctactttctaacatgtgtaggtcttgttttatttcctcagttggtagtaggaaatcttggcttattcctgactttaacgattgtttatgtgaaagatacttgccctcatgtgtaggataaatgctaattgaaaccacactgagattccttgcttaaacttatcagagtgttaaaaatcaaaatgtttgataacactctttgttgtcaagactctggggtaaaagacactcatacgttggaggtaggagtttaaattggtacattgcccatggaaggcaatttggcagcattatataaagatacacatgtattacatacattattttggatatattagtatacttaaataaataaaagtttaaaaaataaatatgcaaatttcctttgatcttggcagggcacagtggctcacacctgtaatcccagcactttggggaggccgaggccagcggatcacctgagcccaggagaccagcctggccaacatggtgaaacctcgtctctactgaaaatacaaaaattagccaggcatggtggcgtgcgcctgtaatcccagctactctggaggctgaggcaggagaattgcttgaacccgggaggtggaggttgcagtaagctgagatcacgccactgcactccagcctggatgacagagcgagactgtcttaaaaaaaaaatttcctttgatctagcaattctagttcagggatacacacacacacacacacacacacacacatatatacaatgaaatctacaatgttatttataatagcaaacaattgcatactacaaaataagaatgagaaacttatatgtactgaaaaggaaaaacatgtatcttaagttactatgactataaaaagagcttggtgtgtactgtgttcctttttgtgtagatagtgaaggagagaacatatatttgttaatttgcctaaagagattctggaggaatacacaagaatctgttgagtggttacctgttgatggggcaaatggaattgaatggaagggagatagagttgggaatgagcctgccctttataaacctctttacttgatatttgagccacatgattgtattatgtatatgtatatgtacatgtgtatatatataatatagtacatacattgtgttttatatatatatatgtgtatatatatatgtgtatatatatatatgtgtatatatatatatgtcttttattttttttgagacggggtctcactcggtcacccaggctggagtgtagtggcacaatcactgctaactgcagcctcaacctcccaggctcaagcaatcctcctacttcagcctcccaagtagctgggactacaggcgcatactacatgcctggctatttattttttattttttgagatggagtctcgctctgttgcccaggctggagtgcagtggcgctatcttggctcactgtaacctctgcctccggggttcaagtgattctcctgcctcagcctcctgagtagctgggatcataggcacatgccaccacgcccagctaatttttgtatttttagtagagacgaggtttcgctgtgttggtcaggctggtgtcgaactcttgacctcaggtgatccacccaccttggcctcccaaagtggtgggattataggcgtgagccactgtgcccagccacggttgtctttatatatattcctagggcttagataagtgtatttatcattttatgaaggaaaaatggctacatgtaggtaattatatataactgtgaacttagtaagagactccaggtttgaggcctgatttttgtaaactttttcactgggccatgtttctacattgctgaatgtagaagagatattatcctggtcactggagcatatccctttggcaatgccaacatggttcattactgaaaaactttagaaaatatatggttttctgccttcctaaatagaatctcctgaaaatcatttaatgttttctggagtattgttgaatagtactttaatatagtgctgtccctaggggtttttgagacatagaaaataaaagcttgcatttattgattattatattgtgcctggcactgtgctaaatattttatatgtgtattttcatattggtcctgtgagacttcacaaatgcaatgaagaatgattgaggttaactaatttgcccgaaatctcttccaaggattgaaaggcagaactttgattccagatttctcccactccagggcatgtgttctttttttttttttttttttttgagacagagtctcactctgtgatccaggctggagtacagtggtgtgatcacagctcactgcagcctcaacctccctgggctcaggtgatcgtccccacctcagcttctcaagtagcggggactacaggcgcacaataccacacccagctaattttttattttttgtagagacagggttttgccatgttgtccaggctggtcttgaactcctgagctcaagcaatctgccagcctcagtctccccaggtgctgggattattacaggcgtgagccaccactcccggccgaccgagcctgtgttcttttttttttttttttttttttttggctgatcagctaattttgaattccaaaataataagttcacaaaagctattattaatgaaaatattcaacacccaaggtgatttacaaagtttaactgagatactatcttgttcccagaacatttataaacacaacatatatatatatatacacacacatatgtgtgtgtgtatatatatatatcattgagttaaatttatatattgaaaataggaatataagatataaaaataaaaaacacaaaggtttaagtgaaagtttttgtaattatatatttatattgggattgcaagatgaatataatgctatttattttattcttttctttctgaatttatagggcttggaagtattttacacagaaaacgatctgtgttctgacatttccctaaagttctttgaacctcaagatagagatgatctctatttttatactgccatgtaaataggtttggtgctcacccttcgttgttttctttttttttttttttttgatactgagtctcactctgtcgcccaggctggagtgcagtggcgcgatcttggctcattgcaacctctgcctcctggcctcaagcgattctcgtgcctcagcctcccgagtagctgggactacaggcatgtgccaccatgtccggctaattttgtttttgtatttttagtagagatggggtttctattcatatgaaggtagttcaactcctaaggatctgggataggaaataagagaagaaaaatgctgtttctagaatcgcctctttgtggttctaatttcttctcatcagtacctataattgccaaaataatatttttaaaactctgggaaatatgaattcactttggtaatagttcattccgagtatgttttaataactctagataaatatatttaaatgcccttatattttaacatccaccaaattaaatggattttgaagaatccactcaaatacatacatacatacatacatacatacatacatacatacatacatatatatatagttgttgttgttgttgttgttgttgttgttgttgagacagagtctccctttgttccccaggctggagtgcagtggcacaatctcggctcactgcaagctccgcctcccgggttcacaccattctcctgcctcagcctcccgagtagctgggactacaggcgccggccacagctaattttttgtatttttagtagagacggggtttcaccgtgttagccaggatgatctggacctcctgacctcgtgatccgcccgcctcggcctcccagagtgctgggattacaggcgggagccaccgcgcccggcctcaaaattttttttttttttttttgagagggagtctcgctctgtcgcccaggctggaatgcagtggcacgatctccgctcactgcaagctccacctcccgggttcacgccattctcccacctcagcctcacgagtagctgggactacagacgctcgccaccacgcccggctaaaattttgtatttttagtagagacggggtttgaccgtgttagccaggatggtcttgatctcctgacctcgtgttccacccatctcggcctcccaaagtgctgggattacaggcgtgagccaccgcgcccaggcgcccggcctcaaatatttttatgtttagtcaggtcttatattagtttatgagaaccaagactcagttttgtactacaaggcagtgagttattcatatgtttgtgatcattgattgtggtcagaaccacaaagctgaaagactgcaaaaggaacatgtgaaccttctatgctcaatatactgactttggagtggaatttgctttttcttttttttttttcttttgagacggagtctcgctctgtcacccaggctggagtgcagtggcgcgatctgggctcactgcaagctccgcctcccaggttcacgccattctgcctcagcctccggagtagctgggactacaggcgcccgccacgacgcccggctaattttttgtatttttagtagagacggggtttcatcgtgttagccaggatggtctcgatctcctgacctcgtgatccgcctgcctcggcctcccaaagtgctggaattacaggcgtaagccactgcgcccagccagaatttgcttttaattaatgttatttccttagtttttcatggaaaatgtgaattttcccacctttgccagagaaaatacttatatttttatattgaagcccaaagttttttttattaagttgcaaggctaaattaaattattctaatttacaaagttgctagataaatagaatggaattatctttaaaagtggattttggggacaggcatggtggcccatgactgtcatcccagcactttgggaggccaaggagggagaatctcttgagcccaggagtttgagaggagccggggcaatgtggcttgacctcatctctacaaaaaaaattaaaaattaggagtttggtggcacgtgcctgtagtcccagctactcaaaaggctgaagtcggaggatcgcttaagcctgggaggtcaaggctgcagtgaaccgtgatcacaccactgcaattaagcctgggcgacagagtgagaccctgtctcaaaaaaaaaaagtggatattgggatttaaaaatatggaacgcttcacgaatttgcatgtcatccttgtgcaggggccgtgctaatcttctctgtatcattccaattttagtatatatgctgccaaaacaagcacgagcctgtgttttttgtttgtttgtttgtttttgttttttgagatggagtcttgctctgttgctcaggctggagtgcagtggtgcgatcttggctctctgcaacctccacctcccgggttcaagcaattctctgcctcagcctcccgagtagttgggattacaggcgcctgccaccatgctcggctaatttttgtatttttagtaaagacggggtttcatcagcttggccaggctgatcttgaactcctgacctcgtgatccaccctcctcggcctcccaaagtgctaggattacaggcatgagccaccgcgcccggctgagcctgtgttcttaaactgttttatggtgaagatccacgatggccccacatataccatagtcaagaaactattgaggcctggcatggtgactcatgcctataatcccagcactttgggagggtgatgaaggcagattgcttgagcccaggagtttgagactagccagtgcaacatggcaaaaccctgtctctacaaaaaaatacaaaaagttagctaggtgtggaggctcacgcctgtagtcccagctactcgggatgctgaggtgggaggaccacttgatcccagggaggtcaaggctgcaggaagccatgattgctccactgcactccatcctgggtaacagagtgaggccctatctcaaaaaaaagaaaaaaaggaagctatttgaatccacgatggccccagatacgttatacttagtgaagttcttggcctagtttttcttattcgttgtttacctttaggtcaccagctattacattttattgttgtcaggcctttactttctcctgggattcttaacccaggaggccaggctaaagatgagagtggacacaatgaggggtgggagggtaagtatagtttttaaaaggcatatttgataatgtgatggttttgattttcatcaaaatgttttgctttcagatttttttttttttgagacagatttcactcttgtcacccaggctggagtgcaatggcactatcttggctcaccgcaacctctgcctcctgggttcaagtgattctcctgcctcagcctcccaagtagctggaattacaggtgcccgccaccacgcccagctaatttttgtatttttagtaaagacagggtttcaccatgttggctaggctggtctggaactcctgaccacaggtgattgcccaccttggcctcccagagttctgggattacaggcatgtaccaccacgcccagccatatttaaaaaaaattttttttataggcagaatctctctctgtcacccaggctggagtgcaatgttgcaatcatggctcactctagcctcctgggatcaagtgatcctcccacctctgcctccttagtagctgggactataggcgtggaccaccgtgcccagcttattttttttaattttgttttttgtagagacagggtctccctgtgttgcccaggctggtctcaaactcttgggctcaagctatccttctgcctcagcaactcccgccccaaatactgggagtacaggtgttagccactggccctggccaggacatcatattttattgagatacaatttatataacatagactttacaaatataatataaaagtcaatgattttcagtaaatttatagagttgtaaaatcttgattacaactcaattttagttcattaccatcatccctgaaagattgcttgtgcttatttgcagtcaatcctgttcctatgccccagccccaaccactaatctattttctgtttctgtagttttgtattttctggacatttcatataaatgaaatcatatagtatgcagtcttttcctctgacgtctttcgcttagcataatgtcttcatggttcatccttgttgtagcatatatcaatactccattcctttttttttattattttttatttttagagatgggacctcgctatattgcccagggtagcaggcagtggctattcatgggcatgatcatagcacactgcagccttgaacttctgggctcaagtgatcctcccacctcagcctcctgggtaactgagattataggtgtgtgccaccacacctgacaccattcgtttttattgcccagtaatattcttttttttttttgagatggagcttcactctttcgcccaggttggagtgaagtggcgccatcttggctcgctgcaacctctgccccctgggttcaagcgattttcctgcctcagcctcctgagtagctgggattctaggtacccactaccacgcctggctaatttttgtatttttagtagagatggggtttcaccatgttggccaggctggtctcgaactcctgacctcaaatgattcacctacctcggcttcccaaagtgctaggattacaggtgtgagccactgtgcccagccttcccattaatattctattacacctaatacattttgtttatccattcatcagttgatagacatttggattgtttccacctttgggtattgtgaatagtgctgctatgaacacttgtacaagtttttgtgtggacatatgttttcatttctcttaggtagatgatatcatatggtaactctgtttaacttactgaggaactgccagactgtgttccaaagcagctgtaccattttacattcccactagcagtgtatgagggttctgttttcttcatgtgcttgtcaacacttgttactgtctttttttattgtagggtatgaagtggcatttcattgtggttttgatttgcatttccacaataagtaatgatgtggaacaactttttatgtgtttattggtcttttggatttcttctttatagaaatgtctattcagatcttttgcctattttaaaattggattatttgtcttgtcattattgggttcttttttttttttatttttactcagggtcccactctgtcaccaaggctggagtgcagtggtgcgatctcagcttactgcaatctccacctcccaggctcaagcgattctcctgcctcagccttctgagtagctaggattacaggcgtgcgccactactgcccggctaatttttgtatttttagtagagatggggtttcaccatgttggccaggctggtcttgaactcctgatctcaaatgatccacccgcctcagcctcccagagtgctgggattacaggtgtgagccaatgcacccggccattattgagttcttgatatagtttgataccatcccctatcacatatatgatttggcacatactttctcctcccctgtaggttgtcttcacctctttcttgaaggtatcctttgaagcacaaaagtttaaaattttgatgaggtgaagcttctctgtttttttggttttttgtttttttgagactgagtcttattctgttacccaggctggagtgcagaggcgtgatctcggctcactgtaacctctgcttcccaggttcaagcgattcttgtgcctcagcctcctgagtagctgggattacgggcacatgccaccatgcctggctaatttttgtatttttagtagagatgggttttcaccatgttggctaggctggtctcaaactcctgacctcaagtgatccacctgccttggactcccaaacagaggcgtgagccaccgcgcccagccgaggtgcagcttcttaattttctcttttatgcttgtggttttagtgttgtggctgggaattgtctgacccgagttactgagatttactccaatgttttcttctaaaagttttatagttttagcttttgtatttaggactgtgatccactttaaatttctgtgtatggtacgaggtcggggtccagcttcattcttttgcatgtggattgcagttatgccacaagtttggttgaaataactgttcttttcctattgaatggtcttaacctctgtattgaaaatcaattgaccataaatgttacggcttttagactctcagttctattgacctatatgtctgtccttaccctgttgttcatttctaatttattcatttttggtaggagagcatgctttgtatgatttcaatctctttaaatttgttgagatttgttttattgcatagcatatgatttttttttcagagaatgttctatgtgtgcttgaaaagaatgtctattttgctattgttgggtgaagtgttctgtagatgtcacttaggtcaagttggttgatagtattgaccaagttttccatatacttgttgattttctgtctagttactctctccattattgagagtggggtattgaaatcttttgctattactgaattatctatttctccagttttgtcagtttttattaaatgtattttgggactctgttgttagatgcgtttatggtatattgtcttgatgaattaacttttatccacgtaaaatgcccctccttttctctagtaacatatttttgtcttagggtactggtttttaaaagactgagggaagatttctttcttcatccttcttatttgcttctttttttttttttttttgagacagagtcttgctctgtcacccaggctggagtgcagtggcatggtcttggctcactgcagcctctgcctcccagattcaagctattctcatgcctcagcctcccgagcagctgggattataggcacgtaccaccacacccggctaatttttgtatttttaatataaatggggtttcaccatgttggccagtgtggtctcaaactcctgacctcaggtgatccacccacctcagcctcccaaagtgctgggtttacaagtgtgagccaccacgcccaggtcttatttgcttcttatcctatactttgggaagccaggtgttagaattattataccagagcaccagtacttgccactcctctattatattaggggtctgaataagattttattttgttttttattttaattaattaattttttttgagacagagtctcactctgtcacccaggttggactgtagtggcttactgcagcctcaacttcccaggctcaggtgatcctcccacctcagcctccccggtagctaagactacaggtgcatgccaccatgcctggctaagtattttttttttttttaaacaggttcttgctctgtcgcccaggctggaatgtggtgacgtgatcttggctcactgcaacctctgcattctgggttcaagcgattcttgagcttcagcctcccaagtagctgggattacaagcatacacaaccacacctggctaatttttgtatttttcagtagagacggggtttcaccatgttggccaggctggtctagaacttctgacctcaggtaaccggcctgccctggcctcccaaaatgctgggattataggtgtgagccaccgtgcccagcccagcctattgtttttaaattaaaaaaaaattttcccaacaccatggacctgaaggcaaagttttttttgttttgttttgagacaaggtctctgtcacccaggctagagtgcagtggctctgtcaatcttactacaaccttgtcctcctgggctcaagggatcctcctgcctcagcctcctggagtttgggctacaggcacatgccaacatacccagctaattttgtaatttttttgtagagatggggtcttgccatgttgcccaggctggtctcaaactcctgggctcaagcaatcctccctccttggcctcccaaattcctgggattataagcatgagctactgtgtctggccaaagattttattttattttatttatttttgagacagggtctcactcagtcacccagtcctgagtgcagtggtgtgatctcggctcacgacaacctctgcctcctgggttcaagctattcttgtgcctcagcctcctgagtacctgggattgcaggcgtaatccattgcacctggcctcaaatattttatttatttatttatttatttatttatttatttatttatttgagactagtctcgctctgtcgcccaggctagcgtgcagtggcgcaatctcggctctctgcaacctctgcctcccgggttcaagcaattctctgcctcagcctctgagtagctgagattacaggcacccgccaccacactcagctaatttttgtatttttagtagagatgaggtttcaccatcttggccaggctggtcttggaactcctgacctcatgatccacccaccttggcctcccaaagtgctgggattacaggcgtgagccaccgcacccagccaaagattttattttttttaaataggttctgtagtaaaaaaaattttgaaggctttccaacttaaattctctggcttaactatttttggctccttgcttagatgcccttttgtctaacttgtggagttttgctcttgaggtttaaaatctcacctaaaatgtttaacatttggggaacgtcggtgaatactggattctttttatgctcttgcaggtttttttttcccaagtcaaaaattatttcagaataaagagttaaactagttaactttttttcacttgcatacaatactagtcttattaagtgactttggaagtgatttggcaatgtaacctcatagagaccttcatgagttcagttcttagctttggtattaacatagatatgtcctagtaatgtcatctggttggcaaatttttgtgagtcaccgtaagactctttcttttccctcacagccatattcattcagacagtaaattttcttgcatttagtagttccctaatgtgttttgaacctatccctcctgccactattttcattcaaacctcatcatctcttctggattgttgcagtagctttttaatgggtctccttgttttacattgtatggcatagaagtccctggtgtctatctgcctctctgtcctcatctgtctgcttcttctgatacacatgtaaacaactgctcatgataccactcatacacttactccatactgtttaatgcctttgcttgtgatcttccctctgcctggatcagctaattatctttctttgagactcaactcaggcattttttttcccagaaaaacttactagaggatctgacttcattcttttgcatgtggatatccagttgtcccagcaccatttgttggaaaaaatattctttcccccactgaattttcttggcaaccttgtgggtttttttggggggatggggagggtggggcaggggtgagacagagtctcactctgtcacccaggctggagtgcagtggtgagatctcagctcactgcatcctccacctcccaggttcaagcgattcacagccttcactgcccaggttcaagtgattctcctgcctcagcctcccgagtagctgggactacaggcacctgccaccatgcctggttaattttttgtattttatagagatggggtttcaccatgttgcccaggatggtctcgaactcctgagctcaggcagtccacccaccttggcctcccaaagtgctaagattgcaggcgtgagccactgcacccggctattcttgttgaaaatcaattaaccataaataatatggctttatttctgaactcaatttttattccatttatctatacatctattcttatgccagaaccatactgtcttaatactgtacctttgtagtaggttgttaaggagtatggatcctccaaatttgttctttttcaagattgtattagctttgattattatgggtcccttgacattctatatgcattttaggattagcttgatgttttctgcaaagaaaccagctggaattttgatgaagtgagttgaatgtgtagaacaacttggagtatttgtctctattttgtttgttttattttatttttattttgtttattttagttcaaggttttttttcttcagcttctcaaattgatatttctgtgcatttttggtttgacataattcttaacaaatctttgtgacaaactgcgccctttgaggtgcgtaacatagtaagaagtatacaggcttaactttgcagtgcatgattgtggtgagaagggaagcattttcttattggtggtttgactactcacttgaaaaactttttcccacatattttcacatgtttattgtgcaaagttttagaaaatacaaaaaagcagaaagaaaaatccataatttcagaattatgtctgtaagcttgtatatattcctttttacatttaaccatataatatatagggaacgtcttttatctcactgaagactacagtgttttattgttgttgttgttgttttgttttttgagacagagtctccgtcgcccaggctggagtgcagtggcgcaacctcagcctcccaggttcgagtgattctcctgcctaagcctcccgggtagctgggattacaggtgcccgccaccacaccctgctaaatttttttgtatttttagtagagtcagggtttcactaaaccaggctggtttggtctcgaactcctgacctcaagtgatctgcccgcctcggcctcccaaagtgctgggattacaggtgtgagccaccgtgcccagcctacagtgttatttttaatgttgtggcatacctcattttgagatacttaattaaacaccaattaggcttatgtttagttttttccataagtgctagaatgaacatctttatagttaaatctttgcacagattcttgactattttctaaggcaagttcctataagtagaattgctagtttaaaagaatacgtggttttgagtctttcttgctattgttttaggatagtgtattaatatttgacaatagtttctgttaaaatctgaaggcaagcttataaatatttgcattatttcaaattgctgttggatgtttatagcagcaacattcacaatagtcaaaaggtggaagcaatccaatccattggcagatgaatgggatgaacaaaatgtggtctataacatatggaatattattcagccttaaaaaggaatgaaattctgatacatgctacaacatcagtggaccttgaaaatattatactaagtgaaataggccagacacaaaaggacaaatgtggtctgattccatttatatgaattacctagaataagcaaattcatagagacagaaagtagaagttaccaggggtgggtgggggctgatagggaatcattgtttaactggtacagagtttcaatttgggatgattaaaaagctctgggcatggatagtagtgatgattgcacaacactgtgaatgtacttaacaccactgaattgtataattaaaaatggttaaaatggtaaatttgacgatatgtatattttagtacagtaaaagaaactactattgatgaattccagaattttagacaaaaaccacctagaaaccatgtggttgttttacttactgtgtttgtcacattgtggctaagtgaactcagggtttgggtactcattttgaatttgatggattgacagatggagctgagaactaggtttctaaccaatattcatgcaatatgaagacagattgagctatatactaagtagtctgctagacactgaggactaatggtaaacaagataagacacagtccctagagtctgctggttcctaagattggacagaaaaaagaataaacttcttattaaggaaaaagggattaaaaaatcaggtgatttgttttctccttaatgatttcctttgtagggtgattttaaaatatctttttcccccccttcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtgattcatgattatccatgtatcatggattaaaataaaataaagggcttgtcccccacatcctagaaattatggtcctttcctatatcctcttaggagctcactccaaacttttttttctcctgttgttttcttttctgttttaaaggggaagaaaaaaaaatctatcatggctttgtttttctttttcttttttctttttttttttttttgaggcggaatcttgatctgtcacccaggctggagtgcagtggtgcagtctcggctcactgcaacctctgccgcctcagcctcccaaatagctgggattacaggtgcacgccactacgccccgctaattttttggttttttagtagagacagggtttcaccatgttgagcaggctggtcttgaactcctgacctcaggtgatcctcccgccttggcctcccaaagtgttgggattacaggcatgagtcatggctcctggcctatcatgactttcttttggaaaaattgttttaatttgttagctttaggaaagtccccaaactcttaatgtctccttttgaaaacttttcataaatatatgacttatgagttgattgttatactaagtacttgagaatgtgatagggaaatatattcagtgtggcatataccttttctctttttctttcaataaaatcttgggggttcatgtggtgtttttcagaacaggaaaggttttacttgattctttgaggacctttactgatagaagctcatgatgcctttgagtttacctcagagagtatctctggaagaaataatcaccagaatctattgaagttattcagctagaatgtgtttagaaatgagaaatgaaagcaacaggagaatgattgaattgcctacatatttggttccataataaatgttcatgtagtacttttaattaatgaagaactaaatagggacagaacatcatagaaggggttataatgagaagttttagacagatgtgggtcaaatataaggaaaacctctgtgacctcagtcagcccataggaaatggttggttattgatcacatgggatgcttaaaattaggatggaataaagccagttgctaagaacaggtttctgttgctcaaattccagtggtctccgtgagtgtaggtgtatatgtatgaaaacaccatgatttcactcattctgaatttgctgtaggttgctgttcagataggttggaatttagtccaggtttctgcatttctaggaagctttttgtttaatgccatggtttccaaactttactgtttataagagtcagtatttgcttcatatgcaaactctagggcccgttggtacaaattctgattcaataaatctggattggggtgcaagactgcaatttttaaaaactttctaagtgcttctaatttagggagtcccttgaacactctttagaaagcaagttacttatcagtcagacccattccggtgggcctcgaaaggtatgtgcatgtgtggagtttgcttggttttcttctcacctgctttttaccctttaagaattttatatggtatacattgtagtagaaatattagataatgcaggcaagcaagcatcagaatgacctaaaattccagtactttgagtacaaggctttaaacattttagtatatacatctttctggtatatgtatgtgtgtatatatatatatatatatgcacacacacacatatatctttctataaaattttataatctttattttcacttatcttgaatctcttttcattatctgtaagtgtatatttatttatttatttttgttagtgtatatttacataattttttttctttttaaattttattttttgatttccaaattttaagttcagaggtacatgtgcaggatgtgcaggtttgttacataggtaaacgtgtgccatggtggtttgctgcataaatcatcccatcacctaggtatttagcccagcatccattagctgttcttcctgatgctctccctcctcccacccacccccattttttattttttatttattttattaattttttaattttattttttgagacagagtctcactcttttgcccaggctggagtgcagtggcatgatctcggctcattgtaacctccacctcccaggctgaagcaattctcccacttcagcctctcgagtagctgggactacaggtgtgtgccaccactcctggctaattttgtttttgtattttttttttattatactttaagttttaggatacatgtgcacaacgtgcaggtttgtttttgtatttttagtagagatgggttttgccgtgttgccctggttggtctcaaactcctgggctcaagccatctgcctgccttggcctcccacggtgctgggattacaggcgtcagccactgtgcctggcctacataatttttttaaaatagatgcctactatttcattataaggttcttctaggttatttaagcagtcccatattgttggatatgtagggccttttatttttttgggagacataatctcacgccgtcatctaggctggaatgcagtggcgctgtcttggctcactgaagccttaacgtcctgggctcaagtgatcctcccacctcagcctccctagtagctgggactgcggatgtgtgccaccacactcaggtaatagtgttttttgtttgtttgtttgtttgtttgttttagacggagtcttgctctgttgcccagggtagagtgcagtggcacaatctcggctcactgcaacctccacctcccaggttcaagtgattattctgcctcagcctccctagtagctgggactacaggtgtgtgccaccacgcctggctaatttttgtatttttagtagagataggggtttcaccatattggccaggctggtctcgaactcctgaccttgtgatctgcctgcctcggcctcccaaagtgctgggattacaggcgtgagccaccatgcctggccgtgtttttattttttgtggaaatgaagtcttactattttgcccaagctggtctcacacttctaggctcaagtgctccttccacttcggcttcccaaaatgctgggattataggcatgagccactgtagcctgccaaggtttttcctctctactattttactattataaccatggctatgatgaacatccttgtgtataatattgaaagttatgtaaattttaatttcatctctgcattgtgacatcagtagcactcaactttgcatgataccatctgtaaatgagggaaataatttccattcacttggtagtagggtacatagtaaagataagtcagtcattttgcaagctgtgtactctagttatgttaaaggatgtttaggtaaaacttgaaaatatttcagtgggagaaactgcataggatactgactttttttttttttttaagacagagtcttgctctgttgcccaggctggagtgctgtggtgcaatctcggctcactgcaacctcctgggttccagcctcctgggttcaagcgattctcttgcctcagcctcccgagtagctgggattacaggcatgtaccaccatgcccggctaatttttgtatttttagtagaggcaggtttcaacatactggccaggctggtcttgaactccggacctcaggtgatctgcccgccttggcctcccaaagtgctgggagtacaggcgtgagccaccgcacctggctgtaggatactgacttctatcattcacctctggaaaggtttaaaaatctcataaggtcttactactcgaagtgtggtccctggaccagcagcatggacatcacctgggagcttgtcagaactgcatattcccaggcctcattccagacattctgaatcagaatctgacttttggtaacacatccaagtgatttgtatgcacagttaagtagagtttgggaagcacttgaaatatgggaccaaacccaaaagctagctgaaacacagtaggcattcctttaatacactaacatgatctttatattatattatgtattctgatttccggcttccagtccagacttctcaaattggaatctttaggagatgagctccaggaacttactgtttaaaagttcccaagatgctgggcatggtggtgctcacctatagtcctagctactcagaaggttgaggcaggagagtcacttgagccccagagtttgaggctgcagtgagttgtgattgtgccccactgcactccaccctgggtgacagaatgagaccctgtctcaaaaaaaagttccctaggtgattggatacatagccagatttcagaatctctaatgtggaggaaatgtaatatataaagtacattttaatttacacagaaaacaacaattgtaattttctgttctaaaaggaatgtcagaattagtggacttatttaatcagtttttggatattgcttcgtcttctccttttttttttttaaaggcaaagtcttgctctgttgcccaggctagagtacagtggcatgatcatagctcactgtaacctcgaatgcctgggctcaggatcctcccgaatagccaggactacaggcataggccaccatccccagctaatttttttttttttgaaatattttgtagagatgccttagcctcccaaaatgctggaattacaggcatgagccaccgtgcccagcctgcatatttgaaattaagaaaaactagcttatttataatcccaggagaataaggggcatcatctttgaattacttcctgagtacaatgcagtttgtaatgtacaatttctcattcttcttctacagtcttatttattatataattaaacaagtctgtagaagaagaccccagtgagcagtttgaatgtctaaattattctagattctttttcattctttttttatatgtgtgtgcgagattgtatatataatatatatataattgatatgtccatacttttgtcttatcaatttgatatatgttctatttattaccattattaaaatatataaactatagcattgacactacctcttgcttaattttctcccctaatgttaggtaattcttttctttttttttttcttttttattttttgagacagggtctccctctgtcacccaggctggagtgcagtggtaatgatcacagctcactgtagccttgaccttgtgggcttaattgattctcccacctcagcctccctagtagctgggaccacagatgtgtgtcaccatgcctggctaatttttgtattttttgtagagacggggttttgccatgttgcccaggctggcctcaagtgatctgcccgtctcggcctcccaaagtgctgggattacaggcatgagccaccaccacctggccttttgatttttagagacagagtctcactctgtctgccagattggtcttgaagtcctgggctcaagtgatcctcctgccttggccaaccaagtagctgggactacaggcacaagccactgtacctggtacttttcttttttttaaattttatttttgcgtgtttgatttgaaatttatagctcaacaataggttttaatacctttttctcttgatggcattcccttcttccccattgtggatatttgagtcttgtgaaataattctgtttgtttgctttttgtagagacagtctcattatgttgtccaggccagtctcgaactcctggcttctagaggtcctcctgtctctgcctctcagagtgctgagattacagacatgagccaccatgcccagcctaattctgtcttttttatcaccaacaaagcaaaggcaaattgtgtaataattcttaacagccccactccatttgtttagaatacattgaccttatggtgctgcaaagaactgggagcgataaattttactgctgatatttgactttgaggatgttgaaaacaaactctcagatttaggatttggctataaacacctgcatttcaagtttttcatattttatggtttccataacttgatttttttaagagacaaggtcttgctctgttgcccaggctggaatgcaatggcatgttgtagctcactgcaacctcaaactcctatgctccatcagtcttccccgctcagacttcctagtggcatgatctcggctcactgcaacctctgcctcctgggttcaagcaattcttctgtctcagcctcccgagtagctgggactacaggcgcttgccaccacacctagctaattttttgtatttttagtagagacggggtttcactgtgttagccaggatggtctcgatctcctgacctcaagtgatctgcctgcctcagtctcccaaagtacaggattacaggtgtgagccactgcacccggctataatttctttcattttaattttattatttttttttagaggcagggtctcactatgttgcttgggctggtctcaaactcctgggctcaagtgattctcctgccttggcctctcaaagttctggaattacaggcatgagccactgcacccagtctttaatttttgtagagatggggttttgctatgttgctcaggctagtcttgaactcctgggttcaagtgatcctcctaccttggcctccaaaaacactgggattacaggcatgagccactgtacctggctcccataactttatttaaaaaatatattaatggggcctggtgcggtggctcacgcctgtaatcccagcactttggaaggccgaggcaggcggatcacgaggtcaggagattgagaccatcctggctaacacagtgaaatctcgtctctactaaaaatacaaaaaattagccgggtgtagtggcgggcatctgtagtcccagctactcgggaggctgaggcaggagaatggcgtgaacccaggaggcggagcttacagtgagctgagatcacgctactgcactccagcctgggcaacagagcgagacttcatctcaaaaaaaaaaaaaaatcaaacaaacaaacaaaaattaatggaaagactttgacctattgttctttgtaaaaactttggtaaattacttggtgattacttggtaaattagtaaattactgtgagtgagggctataagtcgtaagtgctatttagaagactatattttagtttatgatgttgaaagacttggtcacatgttactgaaagaccagtttagcaactctcagaaagaatcagtcacaggagtttgtaatagtttcttcctccactaacaatttgaaaattaacatcacttagcttttacacatggaaatacaaccagtttttgctctatgatgagttggaaaatacttacaccagtacatttatcatttgttttcttcatataatggaactatttcctttttttttttttttttttttttttttgagagggagtttcgctcttgttgcccaggctggagtgcaatggcatgatcttggctcactgcaacctccgcctcccgggttcaagcgattctcctgtctcagcctcctgagttgctgggattacaggcatgtgctaccatgcccagctaatttttgtgtttttagtagagactgggtttcaccattttggccaggctagtcttgaactcctgacttcaagtgatccacccgtctcggccttccaaagtgctgggattacagtcgtgagccacaacgcccggccaatggaacttttttctaaatatagaaacatcatagagatttgaaatatgttttgttgactttttctgaaatgtatttgagtgtgcttgtaataagcctcactctgtggtcagatatgtgattgtgtactttggagggtaacagacctttgaatagcacttagatatctaacaactcgagctatagcctgttaaccgaaccaaacatgacactgaaaagaaataccaaaaggaaaaaaatggcacaatagagtatagcaggttgacacgttgagtgagcattctaatatactttcattatagtaatgaatatactcaaagcaatgcagtggaagtaacagcttaaaaatccatacttccacacctgaagcatctatcaaaattgtggaagaacttatttctattttattttcattcatcatctaagtatactttggggaaaactatattttgagacattagccctattacatttgattgtgaaattagaattagatacgaaaacagttgaatttccaataaaggaaaaagtaatttaaaaagatgctagaatttctgtttctgaatatagttgtttacagtattcgcactgggacatttaattttgctccccaaatatttttatgtccctcttggaaatgtttctggattctgtttagccgtgtaagaaagtgcttcattacattataggcacacgccaaatagtctgattcagtttgatttcccactctcttcatcagatccagccctaaaagtagaattcagtcatggacaaagcgtgattacattgaagggaggagggatagagcttgcttaaatatacatgttctcatctctgtttaaaaactagtcacgaactttattaaatataaaccaaaggcaaatgcttttacaaaatgacaaagggtgggagtggcaggagatagcctttgtctgggaaatagcattaatttccccagttagttgagtgagttagttttgagctaattatttgcttgatagatttaaaaaattgatacatgtggtaagctgaaaatagccccccaaagatgtccatgtcctaatccctggaacctgtgaatatgtcatcttacatttcaaaaaggactttgcagatgcgattaacttaaagatctagggattggaagattaccctggattatctgggtggacccagtgtaatcacaagggtccttataagagggaggcagaatggccatagtcagaggaggagatctgatgatggaagcagaggctggagtgatgcagttgctgacaatgagccaacgaatgtggacagtctccagaagctggaaaagataaggaaacattcttctctagagtcttcacaggaatgcagccctcctgataccttgattttagtctagagagactcaatttggatttcttaatccctacaactagcagataatacatttctgttttaagccactgtgtttgttgtaatttgttacagtagcaataggaaatgaatacaatagactatagctgccatttgttcattcaacaaataaatagtacctgcaatgtgccagacacatgccaagtgctagggacataatggggagaaaaagcagacacaggcctcattttcacaaagcttacagtagaaggagtttacagttataagaaggcttagaaattggagttcgtgaaatgatgaaagggctgtttaatataggtttgtttaaaggaaatggtagggttgacagtagggggcaacagggataccactcctttattacatagttttcttttttaaaaactttttattttgatatattttctactcacagaagagttgcaaaaagagtatagaaagttcctgtatacccatcacccagactccctttatgttaatatcttgtatttttatttttggtagagatggggtcttgctatgctgaacaggctgatctctaactcctggcctcaagcattcctcctgcctcggcctcccaaagtgctgggattacaggtgtgagccaccatgcttggcccttagttgttttttagattgccccttagttgttttttagattgccccttaatttgactttgtcttatgttttctcatgcttagatttagactatgcatttttggcaggaataccacagaagtgatgcaccatcctcagtgcatcataactgggggtacatggtgttgttttgtattactggtgataataatcttgatcacttggttaaggtggtatctgccaggctttctctcctgtaaagttactgtttttcctgttgtatattagtaaatatcttgggggtagatctttgagactatgcaaatatactgttttcttttaaacttttgcccgctgattttagcatccgttggtgtatcttgcatgtcatcattataactgtagtgttctaatgatttttttctcacattccttctgcatttattaattggcattaacctgttagttttatgtgatttctccccagtatacctgttaagtttctggaaacccaacaataggagaatttatggttgagatactttggtatagttagtaatagcaggtatcatatattttccattatcaaaattaacattaatggaacatttatactggtacttaatttgaatattttatttaatccttagaataggtatatgagataaggattattagttttcagatggtggaactgaaatttagatatgttaagcaattttcccaatggagcagagtcaggatttgtattccatcaattatatctatgtaaagcatttacatagatgattgaagaatttcccactcactagttacttgggcagatcattcttttatgtttttaaccattttagaacaaatgatttcttaaacggatcctgtttaagattcttaacattgaactaccgaaactcaagggatgtcagttaatggtgtcattgaagggcacctgaggaatagtttcgtgattagatggtcatggttcagtatctggccttcaccttttgtcaatgtccagaggttggggagttggggagactgacttgtgttcactccagctcctaaatctaggatacaagtttattattttaaaatgagaaatatagttgttaggtaaaatgttctatatagtctttaggctagttacatggggagctaaattataatcagaagctggcttggtgcttatagagtcggaacaaaggagctagatgttcctgtatgtcctcctgctaaggcaagagcctgaccaaatgaaccgaatgctcacattctgattggatgaggacatctttgatcagcagttctggaagataagtgaacctggttctatgcatggtttattgccttttgatttattaccttgactaccacttgtgagcacttttcttttttctttctttttttttttttttgggatggagtcttgctctgtcactcaggctggagtgcgatggcgtgatctcggctcactgcaacctctgcctccggggtcaagcgaattttctgcctcccgggtcaagcgaatttcctgcctcagcctctcgagtagctgggattataggcatgcgctaccacgcccagctaatttttgtatttttagtagagatggggtttcaccatgttggccaggctggtctcgaactcctgacctcaggtgatccacccgcctcagcctcccaaagtgttgggattacaggtgtgagccaccgcgctcagccaagcacttttctttaggtattaataccattgctgtctcaaagctttagtatggtaatatgaccagattatgactattataccgtgatttcttaattgatatgttgatgtcaccttttacaaattatcgttatcctcagtgtctgtttatttcatttagcatgagttctggggtactacaccatctctccatggaaagtggtttgtgaatgagatatctgcactcattgccatgactgctgtttctgagaggcagagtagtgaaccagaaagtgctttggattcagaattcagcgtacggggttccagtgttgcctgtgccagttaggtaccttgggtaagccagatagtttaactggagccttaattttttacttttcttttaaagaaaaacatgataaatactttggatgtactaaaaagaataaagagtaacataatggaaactgtgtacctactgcccagtttaagaaataaaacattggctgggggcggtagctcacgcctgtaatcccagcactgtgggaggctgaggtgggtggatcacctgaggtcagacattcgagatcagcctggccaacatggcgaaactcctcctctactaaaaataccaaaattagcggcgcatggtggcgcatgcctgtaatcccagctactcagaaggctgaggcaggagaattgcttgaacccgggaggtggaggttgcggtgagcccagatcatgccattgcactccagcctgggtgacagagcaagactccatctcaaaaaaaaaagaaaagaaaacattgaggattagagagattacttttaaagcatgtgacgcattttagtgttcaataaatggtagtgttaaaatactgagcaacctcatgtttatcaagaatattcaagctgaggcaggagaatagcttgaggataggaattcaagaccagcctggtcaacatagcaagggctcatctccacagaaagaaaaaaaaaaaaagctgagcataggcatagtggcatgtcccagtagtgtcttgggtatttgggagactgaggcaagaggatcatgtgagcccaggagttcaaggctgcagtgaactatgatcgtgccactgcactccagcctgggcaacacagagtgagaccctgtctctctaaaaagaaaaaaaatattcattgatagagtgctttataagctaagcatcattttgaagcctttgtaatattcatccttacttgattaggttattttataatatagcttttatatcattgttaatgatttctcctttcacatttgcggaaacagatccatgtagcctctgacttgtttctgtagatcattgttggtgtttgcattaagatatatacctgataaggacatagtttactttttggaaatgaaatgcttcttatcttgaataaatatatatacaggttggtcatactggtattgtgccatgtctcaggaaaggttttgtgtacacttttagcattccatatgttataatagatttaatgtttagttaacatttataaaaggataatatttctttttacagtagtgtggagtagttgaaatctatttgataaatttgtatttgactcctatttatcagctatataaatgaacatttataacactgatatttgacataaaattgatatttgatgctttcttcttggtgtccttaccttgagacagcaagatttagggatcattttcatagaccagaattttcccagcatttgactatgtcagcttcattagctagtgctgttctctggtttgtcttttgtggctcatcattcctttcttgtgtaagaattcttattgatgatgtgtgaaagtttctctaccaaagtggttgtcattaatacaataatgcatgtaggggtgtgtgtgtttaaaggatgttactgtggtagctgaaagctctactctaagtattttcctctggattttggtgctactttaacaggtttactttccccttgctaaatgtgaagtggagttttgaagatcttggctctacatttttagtagacttcacctccagcagtatatctgggaaaacagttgtaattttgtaaagttgtttattcctaatgctgactactttcaatctgtagaatcaaaggatgaagtagggtagtttagtatggcacatgaaagacttggcattctactaatttaatcagaaggcatcaaaatttattcattattctggccaggtatggtgactcatgcctataatcctagcactttgggaggctgaggcaggcagatcacttgagctcaggagtttgagaccagcctgggcaacatggcgaaatcccatctttacaaaaaatacaaaaatcagctgggtgtggtggcatgtgcctgtagtcccagctacttggtaggctgaggtgggaggatcgcttgaacctgggaggtggaagttgcagtgagctgagatcgcgccactgcactccagcctgagtgacagagtgacaccctgtctcaaaaaagaattactaattattcttcagagtagatctgctgtctatcatgagtagaggacttctagccagttataggggcacttaagacttattagtcaggttgggctgggtgcagtggctcatacctgtaatcccagcactttgggaggccgaggtgggcggatcgcctgaggtcaggagttcaaaaccagcctggccaacatggcgaaaccctttctctactaaaaatacaaaaattagtcaggcgtgatggcgggcacctgtaatcccagctactgggggaggctgaggcacgagaatcgcttgatcccgggaagtggaggttgcagtgaaccgaggtcacactactcactccagcctggatgacagagcaagactccatctcaaaaaaaaaagaaaagacttattaggccagatagtaaagcataaagactctacttgtttccttgcttttgttctctgagttccttattttttttcaagacagggtcttgctctcttacctaggctggagtgcagtggcgtgaccatagttcactgcagccttgaacgcctgggctcaagtgatcctcctgcctcagcctcccaagtagctaggactacaggtgcatgcctccatgcccagctattttgtatagttggggtcttgttttgttgcccaagctggtcttgaactccttcctagcctccctaagtactgggattacagatgtgaaccactgtgcctgctgacttccttaactttctaaaaaatattttttattgtggcaaaatgtctaatatataacaagagttaccatcttaaccttttttttttttttgagacagagtctcactctgttgtccaggctggagtgaagtggcatgatatcagctcactgcaacccctgcctcctgggttcaagcaattctcatgcctcagcctcccgagttgctgggatcacaggcgcgtgccaccacagccggataatttttgtatttttagtagagaatggggttttgccatgttggctgggctggtctcgaactcctggcctcaggttatctgcccgtcttgacctcccaaagtgctgggattacaggcgtgagccactgtgcccagccatcttaaccatttttaagtgtgcagtttttcagtggcattaagtatatttacatcattgtacatccctcagcaatatccatctccagtacttttttatcattccaaatagaaactctatactcattaaacaatttaacttcccctggctgggcgcggtggctcacgcctataatcccagcactttgggaggccgaggcaggtggatcacgaggtcagaagatcgagaccatcctggctaacatggtgaaaccctgtctctactaaaaaatacaaaaaatttgccgggcatggtggcacgtgcctgtagtcccagctacttgggaggctgaggcaggagaatggcgtgaacccgggaggcggagcttacagtgagctgagatggcaccaccgcactccagcctgggcgacagagcgagattccgtctcaaaaaaaaaagaaaaaaaaaatttaacttcccattccccactctgcctagctcctgttaactactattctactttctgtctctatgaatgtgcctattgtaggtacctcatataagtggaatcaagcaatgtttgtctttcctgtctcgtttatttcacttaccataacgttttcaaaattcatccatgttggccgggtgcggtggctcacacctgtaatcccagctactttgggaggccgaggtgggcggatcacaaggtcaagagttcgagaccagcctggccaacatggtgaaaccccgtccctactaagaatacaaaaattagctgggcatggtggcatgtgcctgtaatcctagctactcaggaggctgaggcaggagaattgcttgaacccggcaggcggaggttgcagtgagccgagattgtgcctctgtactccagactgggtgatagagcaagactccatctcaggaaaaaaaaaaaaaaaagattcatccatgttttgtagcatgtatcagaatttcatttctctttaaggctaaacagtattccattgtatgtatgtaccatattttgtttattcatctgttggtgggcatttgagttgtttctacgttttggctattgtgaataatgctgctatgaacatggttctacaaatgtctgtgtctctgctttcaattcttttgggtatatacctagaatacctaaaagtagaattgctggagcatatgataattctatgtttaatatgttgaggaaccatcatgttgctttccacaacgaatataccattttacattccccagcaatgtacaaggtttctccatatccttgccaacacttcttatttatttatttatatatttatttacttagataatagccatcctaatgggtgtgaagtggtattttattgtggttttgatttgcattgccctgacaactaatgatgttgagcatcttttctcaaagttgtagagattataagtcccagatcaagttctagcttggtgggtttctggtgagggctctcttcatggcttggtgaggagagttgggagtgagctttctcttgtcttcttgtctttttttttttttttttttgagatggagtctcgctctattgcccaggctggagtgcggtggcgtgatctcagctcactgcaacctccgcctcctgggttcaagcgattctcctgcctcaacctcccaagtagctgggattacaggtgcctgccaccacgcctggctacttctttatatttttagtagagacggggttccaacatgttggacaggctggtcttgatctcctgacctcaggtgatccacccatcttggcctcccaaagtgctggggttacgggcatgagccactgcacccggcctctgttatctctttttataaggatactaatcctattggatcaaggacccacccttatgacataaaggtcccgtctccaaatacagtcacattggggttggggttttaacttacaaattttggcggaggagagaggacacaaacattccatctataatacaggggaagatctgctgatctctttgtatagttatgccccctcaaaagtgtgagcagagctaaaagactagtgggctgaccagtcttttagtcttgagggtctaaagggtagacggggtcatttttagtctgcagagtaggagagagagttagcttttgcattctaggagaataaggagcaaacacacttcctcgatgtctaacaagatgttagttgttacagaacagccctcaggggagagactgctatagctccatcactcatgggactacataaggtaccccagggctcccctgagtaaatcaaggactcagaagaggattgaatatgaggggaaaataatcacttttctgacttgaattagtagtctcgataatcaaaaagaagtagtatctaaaagtagatatctagtaaaatctggtaaataactagactaaccaagaaaaaagaatcttacatgcacctttcttcttatcttcaatgctagaagctaaaagacagtagaccattaaggggaaaaggctacaccatccaagaatctctaatcaactaagatatcatctcccagggtgaaaaagatattcatggaccatagtgcagaaaactatgtaatagttgaaaagatgaagctagatctatgtaactaacatatgttgacattgaatgaatggaatatttgataaaagtgctaagtaaagactctacagctagaacagaagtgtgtcagggggaggggcaatcatatagaagtggacagtgtaggggtgattaagtcttttttttttttttttttttgagacaaggtctccctctgttgcccaggctggagtgcagtagcagaatcttggcttgctgcaacctccacctcccaggctcaagtgatcctcccacctcagcctcccaagtagctaggactacagctattgggacgtgcctccatgctcagctgattttttttatttttagtagagacaaggttttgccatgttgtccaggctgatttcgaactcctgagctcgaacgattcacctgcctcagcctcccaaagtactgatattacaggcatgagccatcgtgcctgaccagtgattaagtcttctacatgtgttgtctatgtggcatgatagaaaggggggaaatattagtattttagattatttatttatttttggtgaatgggggctaggtgaagtagggagaacgagtagatgagttactttcttaaaacagataaatatgtttgatcttgagtgtctggaaagggaggctatccactagtaaaaaaggaaaaatattatatatctctttgttttttgagacagcatctcactttgtcactcaggctagagtgcagtgtggcgcagtgtggcgcaaacatggctcactatacagtctcgacctcccgggttcaagcgatcctccagcctcagccccctaagtagctgggactacagacatacaccactatgcccggctaatttttgtattttttgtagagacagggttttgtcatgttgctcaggctggtcttaaactcctgagcctaagcaatgcacccaccttgacctcccaaattgttgggattacagatgtgagccactgtgcctagcctgctacatctcttagttaataatagaaaacaacaaagtgaaataaataaagaacataaaataagattgaaggagtaaaattaagtatattatttgctataccaaatgtggacatgttgcatttacttaataagaaactcagattgtcaggtagagttaaaagacaaaactcacatgtgttgtttactaaaatcatacttaaagcagtgataaagaaaaggtaaaggtgtaaacaagcaaagagaaaacaagagtggcaatgtgttttgttttttttttttttgtttttttttttgagacagagtctcactctgtcgcccaggctggagtgcagtggcatgctcttggctcactgcaacctctgcctcttgggctcaagtgattctcatgtctcagcctcccaagtagctgggattacacgcacgtgccaccacacctggctaattttttgtgtttttattagagacagggtttcaccatgtcgactaggctggtctcgagctcctgacctcaggcgatctgcccgccttggcctcccaaagtgctgggattacaggtgtaagccaccacacctggccccaaagtggcaatgttaatgtacatcaaaaaaggaggaaaacaaggttgaaacattagacaggatattatgaaattatatacttcatagtttacgaagatgtatcaaaaacttgtagacatcaacaacattttggctaaataacctctaatagcattttcaaaaaagcaaacatgtatttgtagtgggaaatttcatgtacatttctttcagcataggagagatctagtgcacaaaaagtgagtaaatacagaggagttgtgccaggcgaggtggctcacgcctgtaatcccagcactttgggaggccgaggcaggtggatcacctgaggtcaggagttcaagatcatcctgaccaacatggagaaaccccacctctactaaaaatacaaaattagccggggtggtggcgcatgcctgtaatcacagctactcgggaggctgaggcaggagaattgcttgaacccgggagacggaggttgccgtgagccaagatcgcgccattgcactccagcctgggcaacaagagcaaaactctatctcaaaaaaaaaaaaaatacagaggagttgaataatataatccacaatccacaaactttatttgatggatgtatagaactttatatccttcaagcaagaaatatacattgttatatgtggcccccaaaaacccttaagttaaagcagagagattttgtacttgcattactcaataagattagaaataaataatgaaataaataaccaaaagattcttaactaattagagagcagaaatcacattcctaggtaaattttgaatcaaagagaaactgaaaactgaaaatgaaaatgaaaatgaaaattataaactagaaagcaatgaaaaagagaagacattacaacaaaacctgtgggtcattgcaaaagttgtacctgttagaaaatttatagcctaaaatatcttcattattaatgaacaataactaaaggaatttagtactcatgttaagaaattaggaaaataacagcaaaagaaaggaagagggaattcagaaaaactgaaattaatttaaaatttatatacataaaaataggataaatagattttattattttgggctttctgaaaaacgattaatgtacctgatgaagaaaatagggcagaaatacacaaggaaaggaatgagaaggccgggcgcaatagctcactcctgtagtcccagcactttgggaggaggccgaggcaagtggatcacttcaggtcaagagttcaagaccagcctggtcaacatggtgaaaccccatctctactaaaaatacaaaaattagccgggcgtggtggtgggcacctgtaatcccagctactcaagaggctgaggcaggagaatcacttgaccccgggaagcagaggttgcagtaagctgagatcgcaccactgcactccagcctgggcaatggagcgagactccgtctagaaaaaaaaggaatgagaaataaaacatagcatgctatgaaagagaataaaagaaattagaagataatgtcatgtacaactttgataacaaaatttttctaacattttgttattttaatttaatttttttgagacagggtctcactccgtcaccaaggttggagtgcagtggcatgatcttggctcactgcaacctctgcctcccaggttcaagcaatcctcccaccttaccctctcgagtagttagggactataaacatgcaccaccacacccagctgttgtttttattattatttttttgtagagacgggggtctcactatgttagccatgctggtctcgaactgggctcaggtgctcctcccacctcagcctcccaaagtgctaggattataggtgtgagccaccgtgcccagcccataccttccttttctaactttttgtgtccaaatttttattgaagttctttgagtaatatggtcagagacggtgtatggggtggtgtactgtctgtgtccctgttgtctagaaatgtaggattttttcacttttaaacttgatggatagcttgtctgggatcagaattttagggccatagttctccctcagaattctgtaaaattgttcctttgacttctagcagttaatgtagcagattagaggtccaatgcctatttgaatgtctcactggttcataaactaatatttctgtatggaaacctagagcacttttattttggcaattcagaaatttaattagattaaatgtctagatgtttaacatttttattgttcttgttctgacattacagatgttttagatatggaaactcagggatttcttagggaaactttcctatctgctttattgctttttctcaattcattttgagatactgtttttcaagatactgatttattacccaggtgggtttataatgtacttatgaaatataatagtgctgcattgccatgttggaggagtcacagtagctaataaaggatatctgtgatgatacaagtcttgagaaaagcattgacaggcaaaaataaataaatatacacatccatgcatatatgcaataaagcattcagttgagtggtattagaaatgtgcatgagaattttcatgactttattttggaacttgttattccttttcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtaagttgaccctgatagtgccaatgtagttttatttggaaataattttcaggagtcataacaatttttataaaataaaactactcaaagaatttttagaatctggccaggcgcagtggctacacctgtaatcccagcactttgggagactgaggagggtggatctcaagactagcctgggcaacatggtgaaaccttgtctctaccaaaaaaatacaaaaagtaaccagatgtggcagcacacacctgtagtcccagctactcaggaggctgaggttggaggatggcttgagcctgggagatggaggttgcagtgagccatgattgtgccactgtattccagcctggttgacaaagccagatcctgtctcaaaaaaaaaaagaatttgtagattcgaatctagtgactgttttaagttaggttaaacaattgagatgttaatgaagtttgttaaaaaaatacagtactgagaagttaatgtttgtgggatattatagaattttagaattaaaaatctattatagagaatataattttattttattttattttattttattattttttgggacagggtctcactctgtcacccagactggagtggtgcagtggcatgatcatggctaactgcagcttcgacctccttgggctcaagtgaccctcccacctcagcctactgagtagctggaaccacaagcatgcagcaacatgcctggctaatttttttaaaaataatttttgtagagatggggtttcgccgtgttgcccaggctggtctcgaattcctgggctaaagcaatctgcccacctcagcctcccaaagtgctagggttataggagtgaggcagcatgcccggccataattttattttgtagaagataatggaaggttggagggcttggtcaagttcaaatatctagtgagcgatactattatgatattatagtattatagtatattattatagtattatatagtataatattatagtattatagactattaattatagtcttttatttctaaccacaattattcatttggtgaataatgacttgtaaatattaaatgtggtttaatcacttgcaaatattaaatatggtataaactttttgtttcctaacatttgtgtatatactaaaattttacatagtttaaccctctagtgactttatataagcagttattaggtagtagagaaggactttctttttaaaattgtgctgccattctacaaaaggccactctggaatgatttttagtttgaattaaaaatgctacacttggctaagtgtggtggctgatgcctgtcatcctagcactttgggaggccgaggcaggcagatcacctgaggtcaggatttcaagaccagcctggcccacatggtgaaaccccgtctatgccaaaatgcaaaaattagcttggcgtggtggtgcatgcctgtagtcccagttacttgggaggctgaggcatgagaatcacatgaacctgggaggcggaagctgcagtgagctgagattgcaccactgccctccagcctgggagacagagtgagacttcgtcttaaaaaaaaaccaaccaaccaaccaaacaaacaaaacagctatgcttggtaggatgtcttatctaagaatgaagtattagattaaatttttgttttgccataacagacaatagaaaacaactcagtgatgggaatcatagtgcataagttgtttgcttatgtaacttaccttaatagtgttcatataataagttggatatgtttgtttacacatggtcttttgtttctttgtataggtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggtgattaaagttttacagtttactggttgggtaaagagagatttttcaattgtataggtctagaacaggaatcagccagctatggccagtgggatgaatgtggctcactgcctgtttttgtaaatcgaattttattagaacacagtcacactcactcatttacagattgtctaggactgcttttgcacctacaagtgacagagttgagtagttgtgtgacagagaccatacaaactgcaaaacctaaacagtttactatctggcccttaacagaaaagtttgccaatactgggcttagactgaatttgctttgaaatacctattatatattggcttttttcagagacatcctaatgtattttttgtgggataataatttatatttaggattattgaaaggttctaaggatgtaagtaagagagtttattaagttaattcagaaaaatttaagtaaaaaggatagaaataaaaacattttattaatcgttacctaatcttgagcattacaaattacactctatcagtatggaaaattaaataaattatttcagtgctttatgtagatatagcaaatattcaacaaattgtatacttaaaaatttgcggccaggcatggtggcccacgcctgtaatcccagcactttgggagcctgaggcgggtggatcacgaggtcaggagttcgagaccagcctggccaacatggtgaaaccccgtctctactaaaaatacaaaaattagccaggcatggtggcaggcgcttgtaatcccagctacccgggaggctgaggcaggagaatcacttgaacccgggtggcagaggttgcagtgagctgagatggcaccactgcactccagcctgggcaacagagcaagactatgtctcaaaaaaaaaaaagaaatttgctttgggggagtagaaattaacacagataatccttataggaaaggggatgtgatcttggtggatacgtttttctcttctataagaatgtggtggtggtgttattttgtaggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtgtaggtataacttttttctttttactttatcagttgccacgtttcatgttgaaattagttaagtttgacttactcaaaactaattttggtttagctctaggtaacagtattaaaattaacaattgtaatgcaacaagccttagatttataccatatgactatgcttcattggagtcatataaaatgctctgtattagtatctttgggaaaatgtacaggtatatcatctatatatatttgtttgtaaggaatttttagttatctattagatggatcttatttttcaaagctgaataatagagaccgactacatggtttcttctaggtctaaaagcctttttatgaaagggcattcaaaatatagttcaatagatacagtatttgggtccctgctatgagtaaatttttgtgttagaaattgtaaggaatgcaaacatgagtaagaagtgtttgctaccctaaagagcttacatttctaataagggaataatataaattcacaaatgactataaaataagaggatgagagtatagtaagggacataaggaaggtagaagcaaagtgttgttcaaaggaggactgcttcatatccagttgggcagctcaagacaggctgtgaaagattgtttcaggtagcttaacattagtaggtattggttttttaaatccttttaaaattaataccttttttttttttttttgagacacagtctgtcgccaggctttagtgcagtggcgggatctcggctcactgcaacctccacctcccgggttcaagcaattctcctgcctcagcctcccaaatagctgggactacaggtgtgcaccaccacgcccagctaattttgtatttttagtagagatggggtttcaccatgttggccaggatggtcttgatctcttgaccttgtgattcgcccacctcggcctcccaaagtgctgggattacaggtgtgagccaccgcgcctggccaaaattaatatcatttttaattgacaaattgttattgtacatatttaaggggtaccatgtgatgttttgagatacacacacacaaatgtggaatgattaaatcaggctagttaacatatctgtcaccccacttgcttattattttgtgtggtaagacatttgaaatttactaagttattttgaaatttacagtatattattgttattatcgactgtagttaccctggtgtacggtagatctcaaaacctactcctcctgtctaactgcaacttgtaccttttgaccaatagctccccatttcctcccccacaactcccagtctctggtaaccatcattctactcttctatgaggtcatcttttttagattccatgtgtaagtgagatcatgttgtatttgtctttctgtgctggtttatttcacttaacataatgtcttctaggttcatccacattgtcacaaatgatagaattttcttctttttaaaggctgaatagtattccattgtatatatataccacattttctttattcattcactgatgaacatgtaggtcatttccatatcttggctattgtgtatagtgatgcagtgaacataggcatgcatatatctgtttgacatactaatttcaattcctttgggtatgtaccaagaagtagaattgctatggtagttctgtttttagtttttttggggaagttccataccattttccataacagctgtaccatttatattcccatcaacaacgtacaagggttcccttttctctgcatcctcaccaacacttatctttcatcttttcgataatagtcattctaacagatgtgaggagatactgttttttaatgcatgcggtataccacatgctttatttatttattttttgagaccgagtcttgccctgtcgtctaggctggagtgcaatggcgctatctcggctcactgcatcctccacctcccaggttcaggtgattctcctgcctcagcctcccgagtagctgggattacaggcgtgcaccaccatgcccggctaattttttgtatctttagtagagatggtgtttcaccatgttggccaggatggtcttgaactcctgacctcgtgatctacccaccttggcctcccaaagttctgggatcacaagcgtgagccactgcgcccggccaccacatactttaatctttatcccctacgagataggtgcaatcttcagtttacagatgatgaaactgagaatcagaggttgtaccttgcccaacttcccgcagctactgataatggtgggttttgaccccaagtctgtctgactctagaagtttgtgtaaggagacaataagaaataaggctacaatccagaatgtgggacattctgtaggacaaatgacctagtttctccaacaaatacattttatgaaacaaacaggaagggagggaggcttttatagaatacaagagacttaagagtagtggtgagctggtaaatgtttaacacctgattctctgaagaaagaaagaatgctgacttctagtatttgctgatttttgtggtataagtactcccactatggctgatttcaggttaccaatgtgacctcactgaatgaagagttgggaagagatgcactgttgcactcattgtatggttatttctaccatgcagatagagtagctgtaaataacctcaaacacataaataatagtaaactgtagtaaaatagttagggagtgatgttttcagtatttattgctttggcttttttttgctctgttttgttttgttttgtttttgagacagagtctcactctgtcacccaggctggagtgcagtggtacgatctcagctcactgcaacctctgcctcctgggttcaagcgattctcatgtttcagcctcccaagtagctgggattacgggcatgcgcctccacacctggctagtttttgtatatatatatatatttttttaataaagatgtggttttgctatgctggccaggctggtctcaaactcctgacctcgggtgatctgcccacctcggcctcccaaagtactgggattacaggtgtgggccactgtgcccagcttaccttggcttttaatgtaatttatttaattgtaaacttttataatttagttttattttaaatggccatgtttaacaattggattgcagaatttctgaaaacttaatagcatttgtgagctggtatgagccagctcatgcacaccctaccctatggaccttgtttggatcctgatttgaacaaaccaactgtaaaaagacatcatttagacaattttgaaaatttgagtatggactgggtttcagatatttgatattaaggaattattcatgagtattttaggggggacgattatatgatttttttttttttttggagacagtgtttgctctgtcacccaggcttgagtacagtggtacgatcttggctcactatagccttgacttcctgggctcaggcaatcctctcacctcagccaccctggtagctgggaccacaggtacacaccaccacacgcagctattttttttttctttttatatttttgtgtagagatggggtttcaccatgttgcccagactggtcttgaactactgggctcacgcaatccacccaccttggcctcttaaagtactaggattacaggcatgagccaccatgcctgagctacacgatttttttttaaaaggttcttatctgttagagatgtaaactggaaaattcatgggtgaaatgacgtgatgcctgagatttgctttaaaatattccaggatacaatatgtgtgggggcagatagctgaaacaaggttggcaaaatgttgactgttgttgaaactggtgatggttacacgggacttcattatgctattctactttcaagtatgtttgaaaatttctataagagctcagaaaaagagataaggctagaatgtgtttttagttttggcccatattttggaaggccataaatagaaaagaatttcgtgttagattttgtaagttacagctcctgaactgtttttacgtaggagcagagaaaggcagtaatttacccagagatgagaaatgagtatatcagtgggaaggtcaaagagggctttttccataggtagaataacaggtcaatttttaaaaattttttaaatgtatttattttagaaaatttatttttatttttaattttttattgtactttgagttgctgttttaataggtctattttttgaatagtgactttattattttatagtaaagtcattaaaaatgccatatcacaattcagatttccatctgtcttaagcttctacattttaggaactaaattaactcctaatttcatcatatttgtctacgatgtaatgctgggctttctgattctatgtcttttgaggtagcatgacaggcgtagaagtagatgttagattgcttcattccataacaattattctttccattgtacctttctgcttccagcttaatttggaattttctattaaatgactgcaatgatcttacttgggttattttttaaatcttaaataaaaggtaatagaatataaaataagcagattcaggaagccaacacagttattatagaaacattttgaattgtctggacttcatttatttgttcttgaattcctagaacctgataattagcttgaggtacatgctctcaatattttattattgtttaaggataaaaataatacagatttcttaaatatataggtatatatgttcatatatatacatatatacccatacatacacatatgtatctactgattgccgtctaccgatggcttctagccattctagaagactgaaatatagtgaattgggctgggtgcagtggctcatgcctgtaatcctagcactttgggaagctgaggcaggaggactgtttgagcccaggaattcaagaccagactgggcaacatagcaagaccttgtctctacaaaaaaaaaaaaaaaaaaaaaattagccgagtttggtggcatgcgcctgtagtcccagctactctggaggctgaggtgggaagatcacttgagcttgggaggttgaggctgcagtgagctgtgatcatgccactgcacttcagcctgggtggacagagtgagaccctgtcttaaaaataaaaaaaaaaaaaaaaatatatatatatatatatatatatatagagagagagagagagagagagagagagagagaattggaatgtttgaaatagagaagcctttattttgaattttcaaaagttttttaaaatagcattaattattttctgatttcaaaaaagtatttgtttatggctgggcgcagtggcttacgcctgtaatcccagcactttgggaggctaaggcaggcagattgcctgagatcaggagtttgagaccagtcaggccaacatggtgaaaccccgtctctactaaaaatacagaaaaattagccgggcttggtggcgtgcgcctgtaatcccagctactcaggaggctgaggcaggggaattgcttgaaccagggaggtgggaggttgcagtgagccaaaatcacgccactgcactccagcctgggcgacagagcgagactccatctcaaaataaataaataaataaacttgtttattatatattgttaattgggattatactgtatgtagatttggggatcctatttttccctacttaatagtacattatgagaatttcccatgtcattaattattctgagaacatttttaatttctgtatattgtcatatatacctgcagatctagatttgaaaatcatactatatatataacataatatgtgtaactttgcctctgttgtcagaagtttagattatttaaggtttttttactgttatttgtagacaacatccttgtcaaaaggttattaaacttatgttctctatatatacacatgtatatttaaatatttcatttaaaacttgactatggtttagtgataaaaataatgtttaataaatgtcatgttgacttgggctttcaattgcatcattgttactagaaaccatttttttctcctagggcataaaaccagccagcttcaataaagtcactgatcctgaagtcaaagaaatcattgaaggatgtattcgtcaaaacaaatctgaaaggtgggtgcaattgtagcaaaatgacataactgaaagatgcatttttctcttatcttgcattgggtcgttttctgacctttcagtcatgctgagtttgacttttgagtagaagccaaaccatactctagattgaagtgtatcagtgcatgttgtttaccattttagacttggatatcatgtgctgaatttttcttgaactgacgtttgggttgcgtttgtgtgtgtgtgtgccttttgacaagctttcatcaccttcagccatcagcttaacagtcagtaggccctcacaagttaatttgcttctaacagttgagagtggacaaaattttaaaaatttgattctatatctttagtgtcatgataatgataaagctaatatggatagaagaaatatgtattcaagaaatcgtattccacatttatttgtgtcacaatttgctttatagacaactcccattactcttagcttttgcctccctttaggttttatttcttattttatttttaattttttttttttttttttttgagacagagtctcgctctgttacccaggctgaagtgcagtggtacgatcttgacccattgcaacctctgcctcccgggttccagcgattctcctgcctcagcctcctgagtagctgggattgcaggtgcatgccatcacacctggctaatttttgtatttttagtagagacagggttttaccatgttggccaggctggtctccaactcctggcctcaagtgatccacccgtctcagcctcccaaagtgctgtcattacaggcgtgaaccaccacgcccaacctgcctccctttagtttcagctttggacagttgctgactttaaattggtgggtttgtcttttgatttttacttccttattgatgattattagtaaaggcgatatatccttagtagaaattttcatggggttattggccatttgtatatctttgcagaaatatctattcaactcttttgcccatttttaattggcttgtttggttttttgttgttgagataggagcttaggcatgcttttaaaaatgaagctaaaaacactatatagaagtagctattttagtttggattctgattgttgtttgtacagcctttaaatatgttctattaccaaagagcactggaatattgcaaaggatttatagcatattagtatattgggaaaagcacagtcttcatcatcagacttaaagtcaaatctgggctcacacttagcctgtgtgaccttgaacaagttagtaattacataaaacaagtattattttgataactaaaaggataataggttgagggtagtggcttatacctgtaatcctagcactttgggaggccgaggcaggaggatcacttgaggccaggagttcacgaccagtctgggaagcaaaatgagacccttgtctctacaaaatattaaaatgaaaaaattagccaggcatagtgtcacacgcctgtagtcccagcccctggggaggctgaagtgggaggattgcttgagcccaggagttggaagctacaatgagctatgatcatgtcactgtactctagcctggatgacagagtaagaccctgtcttaaaaacaaacaggctgggtgcagtggcttacacctctaataccagcactttgggaggctgaggcgggcagatcacttgaggtcaggagtttgagaccagcctggacaacatgacgaaaccccatctctacaagaaatacaaaaattagctgggcgtggtggtgggtgcctataatcccagctactctgggggctgaggcaggagaattgctcgaacctgggaggtggaggttgcagtgagccgagatcttgccactgcactccagcctgggcaacagagtgagactccatcccaaaacaagcaagcaaacaaacaagcaaactaataaaccaaaataattctactgtaaataataaaaattttacagtaaaaattcactataaataatacagtaaaaatttttattgggaagcagagggctttacttggttgtgcctccttaaacacatctcgctttagtcttagggacgggcacagtggctcacgcctgaggctgagtggggcggatcacaaaatcaagagattgagaccatcctggccaacatggtgaaaccccgtttctactaaaaaatataaaaattagctgagcgtggtggcacacacctgtagtcccagctacttgggaggctgaggcaggaaaattgcttgaacctgggaggtggaggttgcagtgagccaagatcacgcgactgcactccgtcccaaaaaaaaaaaaaaaaaacaccaaaacacacatctcattttagtcttaaaagtaattcatttgagcaactttttctttttcaaaaaaatcaactttgtatggaatgatggcttattctatttatgacaccatcttagttaagtatttgtcacttggtcactaaaaatgtagggggttgaaaatcctcaacttacaggatatcatgctgtgtatatactttttctgtttatgtagtgtaagaagaggtctctgtagacattatgcagtacatcagtttcagctctcactggcctgtaatacagagagtttaaatattatgtatctgttttaaaagttagtaaaagtaaattaacttgtccagcttgtaaacaaatcttttgaagctatgtcctttgtttctcttcagagatggttaatccctaatactaggctagggttgtatctgttatatgtatactctggtctaaaaccagagttaaatacgaaaaccactggactttgctgaaccacattagcttcacccatggcattctgtaaagtactttgactagattattgttaatggagacagtgacttctatttataacattcgtaaaaagagtttgaatttttaacgtactttagagtttataaatctgcaagtttttggttccctttgctgagaatctactgtttgagtctgagtaacttaagccagtggcttagggaaatttgcctaacatgtactaagctacttctccagttctcactaggcataattttgtgtatgttaaactttgttatttagatgtattacttgtaagaattcatttttaattgaagtcactccgtatgcatgttagttgggatttctttgcatccctggtaataaattggatataagatttattgttgtttttgcttccacaggatctgttaaagagatttggtttttataacaaggcagattaatgattaaattgatagaaaatttcaaataagttttttgcttttatacaattaatttttagtaattaaagggtcttgctatgattggaagaactgataatgagatatatgttttgtttattaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtaagttaatcataccactattcccctcacctcttattgtatcagagttcattccttgctccttctcattgctttctttcctctcattttctccttttttttgagacagagtctcgctctgtcacccaggctggagtgcagtggtgcgatctcggctcactgcaagctccgcctcctgggttcatgccaatctcctgcctcagcctcctgagtagctgggactacaggagcccgccaccacgcccggctaattttttgtatttttactagagacgggatttcaccgtgttagtcaggctggtcttgaactcctgaccttgtgatccgcccacctcagcctcccaaagtgctgggattacaggcgtgagccatcgagcctgaccttctccttttttctttaaattgttatgttgttgtgaactatatcgctgtgacagtgtattaaatttgtatgtagagtataaagaataataaagctctacatttattaagaaatagaacattaccattaccttaaaagccacctgagtgcctctctcatttgcattttcctccctcatcaccatgagtaatatctacctagattttttttttttttgagatggagtctcactctgttgcccaggttggagtgcagtggcacaatctcggctcaccacgacctctgcctcccgagttcaagcgactctcctgtctcagcctcccgagttgctgggattacaggcgcctgccaccactcccagctaatttttgtacttttagtagagatgtggtttcaccatgttagccaggctggtctcgaactcctgacttcaagtgatctgtccccacctcagcttcccaaagtgttgggattacaggtatcagccactgtgcccggcccctacccagacttttgtgttactcatttctttgtttttcatcatagtttacctgcataatatattgttttgttttgaaaactgaatggcaagcatgcacctagttggtgggaaggggcagtattggtacaattaggtgaagagtcccaggagaggataagctgaagagactttctcagttatagcaattccagcttcagtttccctaagagtttacaagagctacttctggagaagtcagagggtaaggttctaaatgaggccaggaaaatacacccatgtctcagcgcagtcagggcaccggcagggctagtgtgcagaccagaaattagttgtctggttaccatatggtttgatggggagtgggccactctgactctttgcttccaatctctctgtgaccagcccccactctcaatagtggatcacagaaggcaacttctgtggggtgaaatgcatgtccatacctgctccaggcagctgcagtgctgatgggagggtgtgcaggagccgcagcagcatgtactcaaaaccagccgagtacaaaccatctgcgccaggctcacctgggcattctggcctcaggttaaaaagaaggatggggcaatgacagtgggaacctggaaatgatagcctttaacatgtctttctgatcatactgttgttctaaactggaatgattattttggacatctggtacacaactatcaccctggcatttcccattaccatcttcctagacttctctgcttcactcctgtatttaattttggatttcctgaatcccatgtcttcaggggacatgggattagctgggtccactttcagctcctagaagccactcttcagtcctttccatgtctccaccccgtcttcaaagccagcaatggcatattgaatccttctagtgtcagcagctggtaaaagattcaccgagataatctccctagattaaggccaattgtgctatatattatagcaaacacaatgatgggagtgatatctcatatgcacaggtttggggattaagagggatcatcttaaagcagattgcaggactgagaatgatatgtcatggtacctcctcaaatgatcttctctactgttcagccctgttcctctgagatgacgaggcagaaccttttcttctctcactcctctaatgcctagtaagatgtagcactttgctgttagcatacttgcctctgcctagaatgttggtctccactccaaacttctgcacatccctcaatagtgtgcacgttccttttttggctttaattcaggtcagaacttaccttccaggctggatgtggtggctcatgcctgttatcccagcactttggggagaccgaggtgagaggattgcttgagcccaggagttcgagaccaaagcccaagcaatatagggagaccccatctctacaaaaaattaaaaattagccaggtgtggtggtgcatgcctgtgatcccagctactcgggaggctgaggtgggaggatcacttgagcctgggaggtcaaggctgcattgacctatcattgtaccactgcattctagcctgggcaacagagtgagaacctgtctctcaaaaacaaatcaaataaaatagaattcttttgtgaaaacacttactctattaccttcagagatgcagcgtgctcctacttaagacttttacagcagctcatttcaagttaagttatgtccatttcacaccacctgatagtgtgctcatacaggacaaaggaccaacttagtcacctgtatctggtgcctagtactgtgcacattgtagacacttaatgttgctgaatgaggaaacctttttaatccttcaaaaaacgtaatggcagttctaaattacctgtgataagactgcatattctgaaacatcaagttgttttgttcgtttttgtttaaagcctgaattattttaacaatgcttggtaatactattgatttttctcatgccaattagaggctctggcatttatgtatgtctttgtttaagagagaatatagaaacagattaactgttaatttggaatttgggggcataaaataactgctagtaaaaaaaaaaaaagttaaaattggccgggcgcggtggctcatgcttgtaatcctagcactttgggaggctgaggcggtggatcacgacgtcaggaattcaagaccagcctggccaacacagtgaaaccccgtccctactaaaaatacaaaaaaattagctgggcgtggtggcgggcacctgtaatcccagctacttgggaggctgaggcaggagaatcgcttgaacctaggagacagagttgcagtgagccgagatcatgccactgcactccagcctgggcgacagagctagactctgtctcaaaaaaaaaaaaaaagttaaaatcttaaatgttaaagaagtagtttgcttattatgttttgtttgtaggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtaacacagttacagcttgtaaaagcaaacgcatgtgcaattatattctctaatctttatttattttgaagggcagtggtcaatgacctattttgtttcttttcctttttgtatgtttgcttatctttaaatagcacttctgtgctctaaatagcacttctatcatttcatcaagccttttacaaaacccctgaaatagacaagccagctagtttccttattttaaaattaagaaactgttttgttaagtgattcttctaaggtgctagttgcagaaggatcataatctagcatctggttttgtttggggtataaataaaatgatcttattatcatttttgagggtctaacataaatcctttcttttttttgagacagggccttgctctgtcacctaggctggagtgcagtggtgtgatcatgattcactgcagcctcgacctccccaggctcaggtgatcctcccacctcagccccctgagtagctgggactacaagtgcgtgccactacacctggctaatttttgtattttcttttggtagagatggggtttcaccatattggccaggctggtctcaaactcctgggctcaagccatctacccgcctcagcctcccaaagtgttgggattgtaggcatgagccaccgcgcccagccacgtacatcgtttaataaagaaaatttagaactaaagataaaatttattcctcaagaaggaattttctagtctttaagaccctttgtattttaggctcaagtgtaacattaacacaattcctctaattttctgctgtaatgcattttcttttccagaaggacacagtatttgcatagtaataacctattgttctacaaagacagtattctaggttataggagaaagagaatatgatatattttactgaaatccttatgtcaagtgtagattagttagggatatacatgacatggccagcaaatggagttgatttttatctgattctctgtttttaggttggctttactaagaaaattttagttataccacaatgtcaacatttcattgcttgataagagtttacatgctggtttttgattaatgttgtagtgtaaatattttatttgaagctatgtcaggttctcagagtaaaaaagccattaaagaaacaccattacctataccatttggacattttgtgcttcaagttttcccttctacctgttacttattttctttttttataggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcaggggtgaggtgaactgttatatttttaaatatataatcagtgtatttactgtaaatgggaaagtttatctttaatctttttttccccttattttaacagttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaaggtaagacacattttagaggttctgtattcatttaaacaaattaaacactgcctagattttctgacaggcaaaagttctcttttataaattcattatagtttagagaaaggtcaccaaaagctaaaagttgtttatgctttccttcacccaagacattccttttttttttttttttttttttgaggtggagtgtcgctcttgctgcccaggctggagtgcaatggtgcaatctcggctcaccgcaacctccacctcccaggttcaagtgattctcctgcctcagcctcccaagtagctgggattacaggcatgtgccaccatgccccgctaattttttgtatttttagtagaaacggggtttctccatgttggtcaggttggtctcgaactcccgacctcaggtgatccgcctgcctcggcctcccaaagtgctaggataacagacatgagccacagtacccggcccaagatgttcctcttaatgtgtctaatattgtgtaactagaatcttgagatactgcttgtataattggagaagaaacagagaactcagtatatatggacaaaagatttatttaggactgatctcttcctcttattcatgattatttgttctttgtattaaacttttccagcctgatttgaacatggaaggatgtctgttgcagttaattagaaatagtgtttcatagattttcatgatttttagcatgttcatctaaactcttgacttgttttggttcatgtttatttctgtaggagaaataagaagtgtttttgtctttcagactcttaaagtcagcattattcatttctgacaatgagttaatagtctttgtgtgagtttatatattaagactatatcctggttccctaggttatggattctggatgcatggttgcatttttctttgccattacccggttttctcctctcacctcccaccataccttgcgtttgtcttccttctctgggagtgagatgatctaatagctgctagctaacagagaatgcctgatttagctagttgctggtgcatcttttaagagattagtatattatcagttcatcatcaaacttttaatgattaccaccttctggggatatgaaataaaataaacatgatccttgccctcaaagagcccagtcttttaggggaaagcatgtatgtacttgacaaatgccagatgcatttaaaatctgctaggggtagatttagtttgatatagttgaagatgccagatatttggctagtatttataagtgatatggtgcctatttgtaattgagctcatgtggtagtttgatttgcctctttctaagcctataatgcaaagtgtgttgaatgggagcttaaatttaacttaggttcaatttacataagcatacaggtatgtgtattttaaaatgtgttccaaaaatttaattatcaaaatgttacttgcttattttaaaataaagcccataaagttatgaaaaagaaagtgaaaaattacttgttatttctccagctagagacaacttattgttttttcattttgttttgttttgtttcgttttgttttgttttttttgagatggagtctcattatgtcgcccaggctggagtgcagtggcgcgatctcggctcactgcaacctccgcctcccgggttcaaacgattcttctgccacagcctcccgagtaggtgggactacaggcacgtgccaccatgcccggctaattttttgtatttttagtagagacgggctttcaccgtgttagccaggatggtctcgatctcctgacctcgtgatccgcccgcctcggcctcccaaagtgctgggattacaggtgtgagccaccgtgcccggccaacaacttattgtttatgtttgaggtatagcctttagatttatctttttttctgtgtacacatgtataactttgtttatatatacacatgtatatcacatacatatgattttttgtagcctgcccttttcacctaatatatagaagccacataagcaagaaatttgattatatgggtctttttatgagcatggtagcccaaattctaggaattattgcagccaatcagtatttatttctgccaactctctcctctcttcttgagagagtatctatattcattttaggaatgatactgaaatcctttgagctttctcatgggacttccactgtcaggtgtgtgacaatgtcagattcggatactcagaatctctgccagggtttgaatgagttatgtagtaaattgcgataaataagaaaccatgagtggtatattgctgtgacttgtctcaaccccttagtgtattcagttaactagcatttactcatggtattaggatttttataggactaatgctatacctagcacctttttgataatttgctgaaatttttggaacatagcattattttctctatcagtatgtccgggaaagtcccattaaaatgggcatagtatatgcatttataatttgaattctccttgtacctgtagctggcctttggagcagatagaaaaactttagcccaacctatgactttagacttgtcagttactggagttccacaatcagtcctttctttcttttttttttttcagacagagtctcactctgtcacccaggctggagtgaagtggtgtgatctcagctcactgcaacctccgcctcctgggttcaagcgattctcccacctcagcctcccaagtagctgggactataggagcacaccagcatgcctggccaatttttgtatttttagtagagatggggttttgtcatgttggccaggctggtcttgaactcctggcctcaagtgatctgccccgccttggcctcccaaagtgctgggattacaggcgtgagccaccatgcctggccacaaccaatcctttctgcagtttctcttcagacgttttctgcttcacagatgacttcccagcatccaacagttggtcttcaacttgagcgtgatcctagaaatgggaatcaggcattaaccaaagcaccagatgccagtcagacttctagtttcttaccggttaatcaccctcaagctttgttgaatcattcttctgtccaacatgtgagcagtgcacagaatgctgctagtacagctcagctcccttctaattccattggggggcattcaggggcccatcagccttcacaaaagatacattcagtatcacagccatacccatcagaagtctctaacttcagattcttcaatgccacaaagccagactgtgcaaggagtattgtttccaagcttgtattcagcaacaatcattaattttacaacctaagattttggcatctccacagaaaaatgttcagcaggattatgttctccaagagtctgaagctcttgcaagtcagcaacagccaaagggtggtattgaaagtgtgattcagcccctggaatagccttcttattctgttcaacacacttccagggccacctgcggaattatcatccttcccattgaaggctcctgagcagctgccctttgtgatatgtccccagcaacaaacttcttactcatcacagccaacttactcaattcaggctccactacataaacagcctgtttattcactgccagtcctggagcatcctctttacactgtacaaccaccgagatcacagccagcctattctgtgcagacttcttatccagtcccagctgcagtacagccctcatatttggcaaagactcacgtgcagtctgcttatctagtgcaacctctgcttcagtcaccttttccagaccaggcagcatatgcaatccaggcagcttaccttatgcaacctatggaacagcttgcttatcagacactgtctcttgagcatgtatcttatttaggacaaactgcttacactatccagataactgaacatgcaaccttcataacccagcaggtatatacaataagccctcctgatagcaagtgagtacacatgacagacaaactctgcacatcagaagttatactctgtaccaccatttgtagcacagacttttgagcaacaagcctatttaacacaaccccaaggtagttcttcttcaacattggaacaaaggatgtatttaataccaaccttagatacacagacacattctactgagcctttatttaatgtccagctttcagcgactccatcccaagcagatgtcagttttggacaccagcagctaaaaactcaggcccaggcaactagcattatatctcagagggcagtggaaggacagcttcaaaaccctgagcagatgtccttcattcagcaggcctcttcacaggcacagatccagcccccacatttctcagcacagttttcccaatcacatctagcaccaagccaggtttttcacttagctttcattcagcagcagcagatgactcattcatctcatagacaagcacaggaaacccatcagttgtctactcaggaaggtcccataaatcaacagcaatctttatttagtcaacatgctgctctccagcagcaggtacctcattgacaggcacctaagcaagttcagccattaccaggtattccaaacaccattacaaacatggtccagattatacatccattgcaagaacagttgcaactggcagccctggaacaacaatatataatacagcctttagagcagcctcaagtacttcaggcactagataacagtctgacttttcccctacagaaaaacctagcacaataccagccagcatacatccagcagcagtctgctgactggccgcagtggtagccatcttacagcttagcacctgtttctgggtcatcagagccacaattacaacagcagaccctctatcaaagctctgggatagcccttccaaatcagcaatcttcagttcatctcctgacacttagcattctggtagacgcttccactgcttttcagagcatttctgtgttacacacacagcagcatttacaaggccaagaaattccaacggtaaatcctcgtgggggaaaataaggatgattgtgatttttctgtgatgtttaagggtcaggatgatagtgaactataatagatacagcacttcagtgggagtcatggtccctgttcctgactcttttccttacttactgagtgaccttgattcaggtcttttctaaattttctcatctgtaaagtgaagggatcagaccagatgactacaattaaaaaaaatttgaggacctacttaggatataacagtgaataaaatacaaaaaccccttctgtcattgaggtttgttgtctaatggggaaagattgtcaataaccactataaaaaggaaattatacagtacaaggtgctttggggaaaatgtagaggaggaaaaggaggaaagtgggttgcaggtttaaggaagatggctatcagagtaggtctcattgagaaggtaacatttgagcagacacttgaaggaaataagggagtcagtaatgtatatttcagacagagggaataacaggtgcaaaggccctaagggagaagtttgtctggcatgtttggaaaacagccaggaggcaaatgtagctttccaagatcctttagtcctaaaacgtttggaacctatggttctcttattgttctacatttataataaagcatttgcctttgtgagataatactattgagtgattcttattgccaaatactatcccaaaggcattacatgtacatcttcacaccaaccctaggaatcccattattacctttttttactgatgaagaaactgaggttcatagaggttaagtaacttttctagtgtcatacccaaaagctagcatttgaacccagcatattcaatcattttactacccatctgctttgaaagatagttaccctccccaccagaattggagaaaaaggttatgatggcttcagtgagatttagttaatttggggaattgattgctttttttttttttttgagatggggtcttgctctgtcacccaggctggagtgcagtggcgccatctcgggtcactgcaatctctgcctcctgggttcaactgattctcctgcctcaacctcctgagtagctgggattacaggcatctaccaccacacccagctaatttttgtatttttagtagagagagggattcaccatgttgcccaggctggtctcgcactcctgacttcaagtgtttcacccacctcagcctcccaaagtgctgagatcacagacgtgagccaccatgcccagcccttgattgaattaattaaagcaaagaactgagaatctgacttattctttttgctcttctcccctgctttaggtatatctaaaacacactgaatttattgtttggctaataaaatactttgaggtccttagataaaaggtgtgctatgctgtatgagttattttctagtgataatatattactctaccaaacagctattacctcaggtattctgtattttataaaatctcctcttcatcaagggcataaattataatggatttcagtatgtgcgtgctgactcctaacaggactgagcgagaataaataaagatctttgcagctgaagtttcttcagacaggggcatactattctgggatttatttatttcagattaaggggtttaacaaaccattttttcttctccccccccacctttttttttttgtttgtttgttttcctgcactacacagatgtaattaacaaagtattttggattttaatgttcattctgtgggcagattgcacgtgttgtatactttccttacctaattaaaacgttttccccaacatcttattaagaaaaacttcagatatacagaatattggaaaaaattgtagcatgaacacccatatacctaacacctaaattatacagttaacttttgctctatctgctctatcacatacctatttatccctttattaatccattttatttttctggtgcatttcaaagtttaaaggaagttgccaacatcagtatacatcatccataaatacatatcattgactagaactcagtatttatgttttttagtttaaatgtatatacagtaaaatgcataaatcataattcatgagtttcgacaaatgcttacacctatgtaaccccaaccattatcaagacatagaagaggtgttgacagtctttttctgtaaaggcctagatagtaaatattgtaggctttgcaggctatataatctctgttacagttactcagttctgctgttgtatgcatgaaaacaaccataaatatgtaaacaaataggcgcggctgtgttccaataaacatttgctcacaaaaacaggtggtgtgccagatttggcctgaaggctgtggcttgcccacctgatagagaatattgccattactccagaaagttccctcatgccccttcccagtgagttttctccacacccgttagagtcaatcgctgttgattatttgttgttgttttttgagacaaggtcttcctcttttgcccaggctggagtgtagtggtgcaaacacagctcactgcagccctgacctcctggctcaagccatccttgcacctcagcctcctgagtagctgggaccacaggtgcgcaccactccgcctggctaagtttttgatttttttatagagacggggtcttgccatgttgcccaggctggtcttgaactcctaggctcatagggtcttcccacgttggcttcccaaagtgctggaattacagatgtaagtcaccatgcctagccaattttttcaccatagattagcttagcctgttctagaccttcatataaatggaacaatataatatatattcttgtgtaaggcttctctgattcaacatgtttttgagattgatccatgttgtgtatgtatcagtagctttttttttttcttttttgagacggagttcgttcttgttgctcaggctggagtgcaatggcttgatctcggctcactgcaacctccacctcctgggttcaagtgattctcctgcctcagcctcccaagtagctgggagtacaggcatgagccaccacgcccggctaattttgtatttttagtagagacggggtttctccgtgttggtcaggctggtctggaactcctgacctcaggtgatctgccagcctcagcctcccaaactgctgggattataggcacaagccaccatgcccagccagctcattcttttttgtaactgcagaataatgttccattttatggatataccaaatttgtttatctatcctattcacagacacctaagtgatttctggttttgggctattgtgaataaagctgcaatgaacatccctatataagtttttttttttgtaaacatgttttcatttctcttgaattatacctagaaatagaattgctgggtcatagaataagtgtttgactttttaagaaattgcaagttttccgaattggctgcactaacaccagcaatgtatgagagctccacaccctcaccagcatttttaattttagttattctagttgttgtatagtggtatctcatcgtggttttaatctgtatttccccgatgactatgatgttgagtaccttttcatgtatttgttggcctttgtatatctttgtgaagtgcctgttcaagtcatttacccattttatttgctcatgtttgtctttttattatggatttacagaaattccttatatatcctggattatacaagtcccttgtcagatacatgttttataaatatattctccagtctttatattgcccattcgtttttgtaatggtctcatttaatgagacaaagtatttaattttgatgaagtctgattcatcaaagtttttctattgtagttactactttctgtggcccatgaaacctttgcctacacccaagttacaaggaaactttcatatggtttatagttttatgtttaagtccatggttcatcttgaattaatttttatgaatgctgtgaagtaaggggtcaagtttctttttttttttttttcctctaggaatatcctaacagcttcatctgttgaaaagacatccctttctccacatctctaccaacacttgttatctttttttttttttttttttttttgagacagtcttgttctgtcgcccaggctggagtgcagtggcacgatctcggctcactgcaagctccgcctcccaggttcacgccattctcctgcctcagcctcccaagtagctgggactacaggcgcctgccaccacgcccggctaattttttgtatttttagtagagacgggatttcaccatcttagccaggatagtctcaatctcctgacctcgtgatccacccgcctcggcctcccaaagtgctgggattacaggcgtgagccactgcacccagcccatctgtcatttttattgtagacatcctagtgggtgtgatgtggtatctcattgtggttttgatttgcatttttctgaagactaatgatgttgagcatctttctatatgcatataggtcgttcatgtatcttcttttattatctttggagaaatatctattgaaatcctttgcccagtttttattttattcttttattttattttttgtagagatgaggtctcgccatatagccctggctggttttgaactcctggtctcaagcaatcctcccaccttggcctcccaaagtgccaggattacaggcatgagccactgcgcctaacccctttacccagtttttaattgggtatctttttgtctttttattgttgagttatgagttctttatatattctggatacttagaccattatcagatgtatgctttaaaatattttctcccattctgtgtgttgtcttttcaccttcttgatggtgtcctttgtggcataatttttttaaaagtttgataaagtccaatttctcaatgttttctttcgttactttgtgcttttggtgtcatatctaagaaactattgtttgatccaaggtcatgaagattttctcctatattttcttctaagagttttaaattttagctcttaaatttgggtctttgatccattttgagttaattgttgtatatagtttgaggtaggggtctaatttcattctatccatgtggacatccagtttttccagtgccatttattcaaaagactattcacccattgaatagccttggcacccttgttgacaatcaattcaccataaaagtatgagtgttccaacttagttttcctttctcaggattattttggttcctctgagtcccttgcatttccacatgaattttgggatcagcttgtcaagttgtgtccaaaaagccagctgggattttgataggcattgtgttaactttgtatattgcttgggtagtattgtctcttagtaatatgaagtcttcgagtccaggaacatggatgtcttttcattaaactaggtgttctttaagtgttggcaaaggtgtggagaaaagggaacccttgtacactgttgatgggaatgtaaattggtgtagccattatggaaaacagtatgaggctaggtgcagtggctcacacctgtgatcccaatactttgggaggctgaggcacgaggatcactttagcccaggaattcaagaccaacctgggcaacatagtgagacctcctcgtctctacaaaaaaattaaaaaattagctaggtgtggtggcatgtaccccatagtcccagctactcaggaggctgaggcagaaggatcccttgaacccaagaggtcaaggctgcagtgagctgtgattgcaccactgaactccagcctgggcaacagagcaagaccctgtctcaaaaacaaacaaacaaaacagtatgaaagttcctcaaaaaattaaaaaaaaaaaaaactatgatacaatccagccattccacttctgggcatatatccaaacgaaaagaaatcagtatcttgacatatctgcaacctcatgttcattgcagctttattcacaatagccaagatatggaaacaacttaagtgttgacagatgaatggataacaaaaatgtggtgtgtgtgcatatacatacatgtatatgtgtgtatacacacacatacaaagaaggaaattcaggaaatcagccactaaaaaagaaggaaatcctgctatttgtgacaacatggatgaaccaggaggacattatgctaagtgaagccagatacagaaagatactgtatgatcttacttatatgtggaatctataaatatcaaactcatagaagcagagagtagaacagtggttggcaagggctgagaagtaggagaaatggagacacttggttaaagggtataaacttttacttataagatgaataagttctagggatgcaatgtattatttagttgaaaaaaaatttttttttgagtcagcgtctcactctgttgcttaggctggagtgcaggggtgcaatcttggctcacacaacctctgcctcctgggttcaagtgattctcatgcctcagcctcccaagtagctgagactacaggcgtatgccaccatgcccagctaatttttgtatttttagtagagatgggatttcaccatgttgtccagactggtctcgaactcctggcctcaagtgatccgcccacttcagcctcccaaagtgccgggattacaggtgtgagccactgtgcccagccctaaaagagatcttaagtatcctcaccacacatacacgtacaaagggagggtaactttgtgttgtgattgatatgttaattaattttattgtggtaatcatttcacagtgtatatgtatagcaaatcatcacattgtacatcttgaatatatacaatttttatttgtcaattatacctcagtaaagctgggaaaaaatagctggtttttaatttcagcagtattttgtagttctcagaaaatcttttttttttaatttttcaacttttattttagaatcagggagtatgtgtgcaggattgtcacagaggtatattgcatgatgctgaggtctgggatatgactgaactcatcactcagatatggagcatagtacccaatggttagtttttcagcttttttccccatccctttctctcccctctcatagtccccagtgtttactcttttcatctttatgtccacatgtacccagtgtttagctcccacttatatgtgagaacatgtgataatttggttttctgtttctgtgttagttcgcctaggaaaatggcctccagctgcatccttgttgctgcaaaggacatgatttcattcttttttatggctgcatagtattccacaagtccttacaattccttgtaaagttttttcctaagttattatttttgttgttattataaatggaattgttttcttaatttccatttggattgttaattgctaaggcatacaaatacaactgatttttgtgagtttccattatatcctgtaattttgctaaatttgtttatcagctccaatagtttttttgtagattctgtaggaatttctctaataaaatcatgtcatctgggactagagatagttttaattttgctttccaatttatattttttttttttttgagacagagtcttactctgtcacccaggctggagtgcagtggcacaatcttggctctctgcaatctccgctccccgggttcaagcgattctcctttctcagcctcccgagtagctgggattacagttgcctgccaccgtgcccagctaatttttgtatttttaggagagacagggtttcaccatcttggccaggctggtcttgaactcctgacctcctgatccacccgcctcggcctcccgaagtgctgggatttacaggcgtgagccactacgcccggcctagatgtttattttttaaaaaattattcttgctggaacttctagtataatgttgagtaggagttgagagcaaatatcctgcttttcctaatcttagtgagaaaattttcagtctttcaccattaagtatgatgttatctgtgtctttttacttttaaagaactttattcaggcttagtttatgtacgataaatgcatatatttatagtgtacagttaaatgagttgacagatgtatgccataatcaagatacagaacatttccagaacacccaaaagtttcttgtgtcccttttcagtatttgtatgtgtgtgtttactctagggattttaatttacattctgaattcttcacagtttttacatagatttaatattataaaatgtaaggaccatgcaactatttatttcctgcaggctttaagctataattatttttgtttgtttgtttgttgaggtaggatgtccttctgtagcccaggcaggagtacagtggttcagtcacagctcactgtagcctcgacctcccaggcccaaacaatcctcccacctcagcctcccaggtagttgagaccataggcatgcaccaccacacctggctaatttttttaatctgtgtagagacgggtctccctgtgttgcccaggctggttataattgttatgtatattacatctacatacattataaactgcacaatgcaatgttatagtttttgccttatataaacatatgccttttccaagaaattacgaagagaaaaagttttaaattttggtgaggtccagttttttttttttggattgtgctttttgtgtgaagtctaagaattctttgcctagccttagaactggagatattcttctacttttacatttttcatttcagtgtgatctatgttaatgtttttatttattttattttatttatttatttatttatttattttgagatggagtttcgctcttgtcgcccaggctagaatgcgatggcgcgatcttggctcactgcaacctccgcctcccgggttcaagtgattctcctgcctcagcctcccaagtagctagaattacaggtgcccgccaccacccccagctaatttttgtatttttagtagagacgtggtttcaccatgttggccaagctggtaaactcctgacctcaggtgatccacccgccttagcctcccaaagtgctgggattacaggcatgaaccaccacgcccggcctatgttaatgtttttttaagttagaggcattcacaaggtaatatgttaatcttgtatatggttttgagatttagattcagggtttttttttggggagggagtttccctgtagatgtttaattgccatagcatcattgaaaacactgcttgtcttccattcaattgcttttatatttctgtcaaaaatcagtttggcttatttgcgtgggtcttttcttctgggttctctattctgtttaattcatttatgtttttaactctctgttaattacatactctcttgactactatagctatatagaaagccttaatattgggtagtgtgattgctacccaatattctttattctttttttaagtttttttttttagctcttctggatttctgtttttccatatacattttagaataatctagtctatgtccacagaaaaccttgctgggattttgatagtaattgtattagtcctatatatgactttggggaaaattgacatcttgactatgttgggccttcaagttcaggaacatgatatgtctcttcatttatttagatcttctttgatttctttcatcagcattttgtaattttcagcatacaaatcctaaggctcttttgttaagtttgtgcctaagtatctggtttaattttgaaggattataaataattgtgctcttttttttttttttttctgaggcagggtctcactctgttgcctaggctggagttcagtggcgtgatctcagctcactgcagcctctgcttcccaggctcgagcaatcctcccaccacagcctcccaaagtagctgggactacaggtgcatgccaccatgcccggctaatttttgtacttttagtggagatgaggttttgccatgttgcccaggctgatgttgaattcccgggctcaagcggtccacccacctcagcctcccaaagtactaggattacaagtgtgagccactgtgcctggctaatattgtagtttttaatgtcagttttcacatgttccttgttagagtatagaaatgtgatcgtgtgtgttgatgttgaattcaaataccttgttgaacttacttatttgtcctaggaggatttgtttgtttttttggtagaatccttggaaatttttttaaatatagaaaatcatggccgggcgcgttggctcacgcctgtaatcccagcactttgggagactgaggcaggcagatcatgaggtcaagagattgagaccatcctggccaacatggtgaaaccccgtctctactaaaaatacaaaaattagctgggcgtggtggcacgtgcctgtagtcccagctactcgggagactgaggcaggagaatcccttgaacccaggaggcggaggttgcagtgagccgagatcgtaccacctcactccagcctggcaatagagcaagactccgtctcaaaaaaaaaaaagaaaaaaagaaaatcatataatctcctaaaatagagacagtgtgatctctccctttctaatctgtatgctttttatttcttattttccttttattgtgctggctagaatttccagtactgtactggaataagagtggtgagaatgtactgtcttgaataagagtggtgagaatgaacttccttgctttgttccgagtcttaggggggacaagtctttcaccattagtatgatatgagctacagattttttatagatgctctttatccagttgaggtagttaccctctattacctgactcactgagaagttttattatgaattaatgttggccaggcgcggtggctaacacctgtaatcccagcactttgggaggccgagacaggtggataacctgaaatcaggagttcaataacagcctcgccaacatggcgaaaccctgtctctactaaaaaatacaaaaattagccgggcgtggtagtgggtgcttgtaatcccagccactcgggaggttgaggcagggagaattgcttgaacctgggaggtggaggttgcagtgagctgagatcgtgccactgtacttcagcctgggtgacagagcgagactccttctcaaaaaaaaaaaaaaaggaatgttgcctttttcagatgtttcttctgtgttaatgatatgattatatggttttgtttttttttacttgttgatatatagtggatgacatggatttcaaatatcgaaacagccttcatgtccttggaataaactcatttggtcatggcatatgattctttgcatacattgtttgattcactttactaatactttgttgaagatttttgaaccttaagttcatgacagatactgatttgtagttcagttttatgtctttgttaattttctattattaattgctgagagtgaggtgttgaagtttctaagtataattgtagatatatgtatttctccttttaacgcagtaatttgtttttttttgtttgtttgtttgtttttgagacagagtctcgctctgtcacctaggctggagttcagtggcacaatcttggctcactgcaacctccgcctcctgggttcaagcaattgtctcagcctcctgagtagctgggattacaggcgtgcaccaccatgcccagctaatttttgtatttttagtagagacgagtttctgccatgttggccaggctggtctcgaactcctgacctcaggtgatccacccgcctcagcctcccaaagtgctgggattatagatgtgagccaccgcgcccagcctacacagtcatttttttttacttctgttttgaagctcttatttggtgcatccacgtttaggatggctatgtctttttagtggattgatctttttatcattatattatatccctcttcatttcttgtaattttctttcctgtgaagtcaactttatctgatattatgtactccctgctgctttttattgcttaatgtcaacatgatatatttttccatccttttactttcagcctatcctatgtttcaagtgagtttcttgtagaaagtgtatagttaatgtttatccatgttttttatcccttctgtcaatgtctcttaattggcatatttagactgttttgcattcaaagtaatttttgatatgctaggatttaagtctatcatgttagtatttgcattttgtttcttctctatgtttctccttcttatgcttctcttttcttacccacctgtgggttatttgaaattttttaggattccttcttggttttcttttgcttggtcatgaacttcttgttttatttatactgttttgagtatattatactgtacagttttcttagtggttgctctaaggtatccatacacacacacacacacacacacacacacacacacacacacacacacacacacacacatatgaacttataccctacagataccgacattttaccacctctagtaaaatattgaaatctgagttccatttagatctgtttaccactcccacttttttctgagccggagtctcactctctcgcccaggctggagtgcaatggtgcgatctcagctcactgcaacctccgcctcccaggttcaagcgattctcctgcctcagcctcccaagtagctgggattacagctgcctaccaccgcacctggctaatttttgtattattagtagagacgaggtttcaccatgttggccaggctggtttcaaactcctgacctcaagtgatcttccctgcctcggcctcccaaagtgctgggattacagacgtgagccactaggcccgaccttttttttttttttttttttatgtgacagggtcttgctttgtcacccaggctggagtgcagtggctcagtcatggtctactgtagcctcaacctcctgagctcaagcaatcctcctacctcagcctcacaagtagctgggactctaggcatgtactaccatgcccagccttttgttgtttttgttttcttgtagagatggagtcttgctatattgcccaggctggtctcaaactcctggcgtcaagcagtcctcctgcatcaacctcccaaagtgttgggattataggcattagccaccatcagctcccatcatctttgaacttatctgtacacaagaagatgttccagacctatcctattcttccttgccccagctttataatcagtcatctccagtgagctctggttgagagggtttgttttcatggagaaataatctcatttataggaagaatgatttaggaatgagggaaaatttcttgaaataggaaaaaaattaccgtagtgatgtccttgagaagatgagaggagatgacatttagtttctacatagaggggttggccttagcataggagtacagttgtccataataataagcgtgaaggtagagattatggccataaatgctatttaggtgggtggatgttatggaaattatctttttgttgccttttttattttctcagtgaaatggaagcaatgtcatcagctgagaatgaagttaggggagggagtgtgtattagaagtttaatgatggaagcaaaagtattaaatagttacatagaagaatggtagtagaatgaatgaacaagggaaatgtagtgagattgccaggcagcattaaggatcctcttgaagttaattaaagagttaatctctttgttgagtttggtgcttcttttttttctaagttttagtgtttctcaaggatttggtgattcttggttttttattcagtcatatttaagggtcctgttcacctgtctgatttgtttacttacagtagcctgccttgctgccagttactgtagaggagagacaagttgtgttgggagcacgttttcttagtagtttgttacctgtagatttgttcttcctctcaggctctaccttgagtttttgggcaaatttccttgctgctcactatttagcataatgaggggttaggagaggataggattgcctagcctagctgctgttaattcaccatatcatttaatctcccagatgaattccccaaagccaggcaatcttctggtatccattgagtagttttagagcttccccaaatcactcctaactttgcaatagttttctcctatatgtgcgtttgaagctttggtttccatatattttgttccccatggatgtgatctattggtttctgttcttttggaaggttctttaccatttatggtctgtggatggcattctttttagtttttctgggatgttatgactttattctagtttttgttttttgctttaagatgggagtctcgctctgttgcccaggctggagtgcagtggcacaatcttggctcactgcaacctccgccttccgggttcaagcaattcctggctaatttttgtatttttagtagagacagggtttcatcatgttggccaggctggtctcaaactgctgacctgtagtgatctacccgcctcggcctcccaaagtgctaggattacaggcgtgagccaccgtacccggccaattctaggtttttaaagtaataatttctgttgctttctagagtattaggtagttggtaagacagatgtatacgttcgttgttaccatattgattcagtcacagaatttctcttatctacatgaataatgtggattgacattaaaagggaaaataacttagtgattttgttgttgcaaatatctagcgttgacaactagaagcaggggtttcattcaggtttttgttgatattgttttcataagtactgactggattggccagatttcagactttgaatgcatgaggagtcattgaaaggttatgtattacttgttttcatggctaaatctacatattagcatagctgagttgtgtatttgtaagattactctagaaattgtggttctattttctattttactactattcatagcttagccaatggaatcatttgctttgttaattccagtttcttaatcagtgaaggtaatatctttatacttcagtctttatcttaattctagccatggtatgttttagacccatatagttactgtggttatcagtggttttaagaaattggctttgtttctggtgacatttctattcttttagtgcttacaaaacagtacagaaactatatgaagaatggactctgttgatgtgtataacactgacattaattggcaaaagattctctacgttcagtttgttcagaaatatccatgggcctactgtgagtgaatattattaaaacactccacacctgtattctggtaatgaccattttattatgtaaccagtttctgagactagctggctgccttccttacttccttcctccctcccttcttcccaccctcttttttcatccttttttttttcttttgagatacggtttcactctgtcacctagtgcagtggcactatcatagcttattgcagcctcgaactcctgggcttaagtgatcctgctgcctcagcctcccaggtagctgagtctgaggcattctaatggagtgaaacttatagttagggagttgacattttttgaggacctgctatgtatcaagcagtgtcatttcgtttaatcttcactgtagcttcctctataaagtagttaattccattacatggaaatatttgtgtaaaaatcgagaaagttataactgatttctctagagagatattctagtttccagggaatcagactatttctgtaaaaatgctatttagcacagtattgtatttatgtgaaattgctttattctaattgaagggaaatcagtttaaacagtgggtgtgtttgctgaacattgtcaaaaagtgttcccaaaaggcatgtattgctttgtatctattcatattgttgaaactggtaataataaggacattagtcatttggattgatttccagtgacattattcagccctctcccttttgtaatgtaaatcagttagaatactgaagatgttgaagtggggagaacctttcagattgatctcatttttccaggaaggagccagcttcgtaaatagcagcacagttgaactcttcaatttgggaggttggttgaatgagctaaaagactgattatttgcggattaccatgataaggtatttaagaaaaaggcaaactgttgttttgggaggatagcaattatgaaagctttttaaaataattttatcatattatacatgttatattcttgatttatatgtgtacattcaattttgaaactacaattctaacaatttggactcaatattaactattggttttagtatagatcaccagtttttataccacatattctctattcttgatttttaaattttgctaagtacctgtgtagtttgaagaatggctttgtgtaatttttcaaagttacttgggtttgaaatttctgattctttggatatccgaaactgacgtttcatttacattcacacatgaacaaaaacttgttaggcattaaaaaaaaatcagtttacagtctttttttcccatctacatattttgttcttttgtcttcttctagctaatgcttcagaagagaagcctaggcctgtctgattttttttgttcccttttcctcctaagtgcttataggtggtattctttatctttataagtaaaaagtttggtatatatatttttttaattttcagaattctttgggtatggcatacatcttttatatgtcttggtatggatcttttatttcctcacataaaaatagctttttaggctgggcgcagtggctcacgcctgtaatcccagcactttgggaggccaaggcgggcagatcacctgaggtcaggagttcaagaccagcctggccaacatggtgaaactgtgtctctactaaaaatacaaaaaaattagccaggcgtgcagccataaaaaagaatgagttcatatcctttgcagggacatggatgaaactggaagctattattctcagcaaactaacacaggaacagaacaccaaacaccgcatgttctcactcataagtgggagctgaacaatgagaacacatggacacagggaggggaacatcacacaccgggcctgttgaggggtcgggggaaaggggagggagagcattaggacaaatacctaatgcatgcggagcttaaaacctagatgacgggttgataggtgcagcaaagcaccatggtacatgtatacctacgtaacaaacctgcacgttctgtacatgtatcccagaacttaaaattaaaaaaaaaaaattagccaggtgtggtggcaggtgcctgtaatcccagctacttgggagggtgaggcaggagaatcgcttgaacccagtggtggaagttgcattgaaccaagaccacgccattgcactccagcctgggcaacaagaaagaaactctgtctcaaagaaaaaaaaaaaaaaaaaagaggccgggcgctgtggctcacgcctgtaatctcagtactttgggaggccgaggtgggcctgaggtcgggagttcaagaccagcctgaccaacgtggagaaaccccatctctactaaaaatacaaaattagctgggcgtggtggtgcatgcctgtagtcctacctacacaggaggctgaggcaggataatcgcttgaacctgggaggcggaggttgcagggagccgggatcacgctgttgcactcgagcctgggcaagaagagcaaaactccatctcacacagacacaaaaaaggagctttttaaaaataacttttcttctcataaatactttttaaagtacagaaatgtataaagaaagttaaagttacctatgatcctacctctcaaaaacaaaacttttgtagtttttctagacattttccatgctatgtgtgtatgaaaaatgtgtggtattttatcagaattgaatcataccagctgttcttcaaatttttttttacaaaggtatatacattcattaaggtatcctaaatgtacagtttgatgagtgttcatatatatatatcttcatgaaatgcaaatgaagatatagaacacttccagccccctagaaagttcaccgagattcatctacattgttgcatgtatcaatagtttgtttcattgctggtagttgttctgttgtagaatatatcatgattcagttatccattctcctatccatgtacattaggattggttctagtttttggctcttatggataaagctgctgtgagctttcctgtatattttttggtgaatatatgcactcatttctcttgtgtatatacttaggaatgggattgttaggtcacagaataagggtagttttagccataccttatattgccagacagttttccaaagctattgtactgaaatacgttcccgctggcaatgtatgagacttccatttactctgcatccttatctgttgtcagttgtttaaattttagctgttttgatgagtttgatgtggttatatattgtggtttttaacttgcattttcctgataaataatgatgttgagtgttttttcatataattattagagattcaaataccttctttggtgaagtgcctattcaaatcttttaatttttgtatttagtctgttttaattttgagcgattcttcaacctttttctgtctttcttgacagtattgcaatgcagaggccagttgtttttttttatagaatgtctctcagtttgggtttgtttgaagtttcctcatgattatattcagataatgcattcttggcaggaatactgtgtgagtgatgttgtcttcttatcagtgcatcataatagaagtaatgccagtttgtcccaatattggtgaagttaacttttattacttggttcaagtggggcctgccaagcttctctactgtaaagttatcgtttcttcccttatagtttatgagttatttgtggggagatattttgaagctatgtaaatatccctttcacttactagttttagcatccatttatgattttctagctccatcattcctctttattagttggccattctccctcatttatttatttatttatgttagtatgaactcatggggaccttattttatttactaggttatagtataatactatcattatttatttagatggttaaaatgccctagatttgggggaccattcatggtagcatttgtgtccttttgacattttcccatcattctttgaacacttccttattttctggccacagcaagacagatattccaggctcattttgtcttttccctgcccctaccctggaatccagctatttctccatggagttctgattcctttaatttattgatttatttgcatttttaaaaatttttttgaggcagggtcttgctctgtcactcaaggtggagtgccagtggcaagatcatggctcactgcagcctcaacctggctcctgggctcaaataatcctcccatctcagcctcccaaatagctgggactatatgcatgtgccaccacggccagttaatttttttagtttttattttttgtagaggcgaggtattgctcagttgcccaggctggtcatcaactcctgggctcaagcgatcccctcgcctcagcctcccccttattccttttagtgggtaatgtaatttagaaaaaaagcctgagtattgggtgtgtttgctgctactggggagttattgcttctagagttctcagcagacaggctaggaagtgtgtgtgtgtgtgtgtgtgtgtgtgtgtgtgtgtgtgtgtgtgtgcacgcattcagatatcttaggtgactttgcttttgactttgtgttctaggagagaatttatatattttttgccatgtatctccagtgtacatgcaagatctccacttggttgtataatgacgtttcaaattaagtatatccaaaatcgaacacttacatttgcactttccaccaccccaagcctgctcttttcactgtcatccccatctcaacaaatagcaactctgtctttccttactcaagccatatggctatggtttttttgttgttgttgttgctctttttttgagagagtctcgctctgttacccaagctggagtgcagtggtgctgtcttggctcactgcaacctccgcctcccgggttcaagtgattctcttgcctcagcctcccaagtagctgggattacaggcacttacaggcacacaccaccatgcccgcctaatttttgtatttttagtagagatggggtttcaccatgttggccaggctggtctcgaactcctgacttcaagtgatccccccacctcggcctcccaaagtgctgggattataggtgtgagccaccacactcagttagctatggtcatcttttattctttgctttctctcatattccacttcaaactatcagcatgtcttttgactctttttacaaatttttgtgggtaaatagcaggtgcatatatttatgggggacatgagatattttaggcctggggatggtggctctcccctgtaatcccagcactttgggaggccaaggcaggaggatcacttgagccgagaagtttgacaccagccaaggcaacatggcgaaatcctgtctctaccaaaaagaaaaaattcttttttatggcttcatagtttcctatggtgtatacatgccacattttctttatccagtctatcattgatgagcatttgggttggttccaagtctttgctattgtaaatagtgctgcagtaaacatacgtgtgcatgtgtcttcatagtagaatgatttataatccttttggtagatacccacatgtatgaagctggaaaccatcatcctcaacaaactaacacgggaacagaaagccaaacactgcatgttctcactcataagtgggagttgaacaatgagaacacatggacacagggaggggaacatcacacaccgggacctgtcgggggatgtggggaaaggggagggagagcattaggacaaatacctaatgcatgcggagcttaaaacctagatgacaggttgataggtgcagcaaaccaccatggcacatgtatacctatgtaacaaacctgcacgttcagcacatgtatcccagaacataaagtaaataaaattatatatatatatataaataaattaaaagttagctgggcatggtggcccatgcctgtagtctcagcgactcaggaggctgaagtgggagtattgcttgagcctgagagatcaaggctgcagtgagtcttaatcacattattgcacttcagcctggctgacagagcaagaccttgtctcaaaagaataaaaagagatattttgatacaggcatacaatgcataataatcacatcagggtaaatggggtatctatcacctcaagcatttatcctttgtgttacaatctaattatactcttaattatttttaatgtacaattaaattatcaactatagttgacttgtgctattaaatactagatcttattcagtttttctgattaatttttgtacccattaaccttccccactcccctcctgactctccccactacccttcccagcctctggtaaccatccttctactttctatctctatgagttcaattgttataatttttagctcccacacataagtgagaacatgccaagttcatctttctgtgcctggcttattgttcacttcatataatgacctccagttccatctatgacaatatctcattcttgtttattgctgcatagtgctctgttgtgtatatttgatttgactcttactttaacatatatctgcatcctgacttctcaacaccttcaccattgtcgtgctggtctaattcagctctttttttttttcgctgtcttgtccaggctggagtgcagtggcacgatctcggctcgctgcagcctctgcctcccaggtagctgggagtacaggcacccgccaccacatctggctactttttgtatttttggtagagaccaggtttcaccatgttggccaggcaggtctcgaactcctcacctcaagtgatctgcctgccttggccttccaaagtgttgggattactggcgtgagccactgtgcccagcctcatctcttgaataattgtagtagtctcctaattgttcttgcttttgcttttgttcttttgtagcctttttcttattgtaggaagcagtgatagttttaaaatgcaggtcacaacatgtctcagagacccacaacctctcgttgctcatctctttgatagtaaaagccacaataatgtactaatggcctgcaaagtcctacaggatctggactcccctgcacaactctctgacctcatgtagattttctttgacttccgttttcctcttttttttcagacggagtctcgctctgtcacccaggctggagtgcagttgcgcaatctcggctcactgcaacctctgcctcccaggttcaagcgattctcctgcctcagcctcccaagtagctggaattacaggcacatgccaccacgcccggctaatttttgtactttcactagagacggggttttaccatattggctaggctagtcttgaactcctcacctcaaatgattcgcctgcctcagcctcccaaagtgttggcattacaggcatgagccacccacaccccgccccattttcctcttgaatgatgattaaaccctttcataggcctatagcttgaggacaaggagatgcacactttctgtgtattagtaagcattgatttattctggttcttctgtactgaagtgtggtttactttttttactcccataatgaattatccaatgttctgaaataatcaaatactttaaagactatgatctccaacatgcagggctgccaaaatgtgtctgcatccttgctcatttggctttacttataagatctctaccttccagactgcgaaatggctcagtctgtcctctccttttcttctccagtatgcattctcattcttgccattaaaaaaaaaaaaaatgttagttgctctttccaaatatctgtagaaagctttgcagggctgaggcaagactgtgcctgatcagtttgttagttcttacagacctttgatcacttaacggggcagtattagaataaaagtttggaatttaagtctgctttcatgaagttaggctcccctcaattcagttctatctgccttacagttaatggaacttcttcctagttcctatcactctttcatctctcatagttcctatcactcttttatgtgtcagtctttgtagtgctggtatgttttcatcattttggcctatgtaataggctggatgtcattatgtgagttttatcccaggaaccgtgcttttggatcagttttttaacttagggtaaatttcatcgttcaggcctggcacggtggctcgtacctgtaatcccagcactctggaaggtcaaggcaggaggattgcttgggcccaggagttcgagaccaacctgggcaacacactgacacccccatgtctaccaattttttttttttgagacagtctcactctgtcacccaggctggagtgcagtggcacaatcatggctcactgcaacctccacctcccgggttcaaacaattcccgtgcctcagcctcccaagtaactgggattacagtcatgtgccaccacatctggctaatttttgtatttttagtacagacagggcttcaccctgttggccaggctggtctccaactcctgacctcaggtgatccgcctgcctcagcctcccaaagtgctggattataggcatgagccaccacacctggcccaaattttttttaaaaaaattagccaggtgtggtggcacatgcctgtagtctcagctgctcaggaggctgaactgggagaatcactttgagcctgggaggttggggctgtactccagtctgggcaacagagtgagaccctgtctcaaaaaaaaaatgtttagaatcttgccttcaccaacaattggccttatacaagacaacgtctttatagatgaagaattctatataaatataaaaatatggaagtgggcatcatgcacagtgataattttatttaattaaataagcaaaaattccactgttaaccaggtatatacagcatacatataggcttgagccaatttgtgtcattggtcagacctggatttcaactctggctctttgaactcactgtgtgacttgaggaaagttatttaatctcgcccagctttggttctttttagtgtgaaatggttttaaatggttgtaaaagttttaaaatgcctatcttgcatttgcaacctactttgaaatatatgggataatgtacatatagtaaaatcctgtagactatgggtggtgttagatatataggttttcacagaacaattccacttttctatgtgttggaaaatttttataatgttagaaaaaatgcctgtattgcaggcttattaggattaggtgatataaaatatgagaagtgtctggcatgtaataggtactcaacaaatagtggttgttaaaagtacttcaggggagagatatgctttgtaacatcaataacataataaagcaatttatgaaatgtttaaaagtacatcccagttttactggtctccttcactccataataactgaataagaatctctgggatgttgtacatgggcttagctttttatctcttttgtcctcccatctccccttctggggctgagaaccactaatgggaggaggagaggagtggtggagcaagtaaaggagaaagatcctcctcaacaccttcccgaggtttggcattacataagacctcagaaccagttaggggagcctcaagaatataaccaagattgattccctgctcctgccccagcagaagtagctgtatctacttttcttttcttttttttttttttttttgagacagtttcactcttgtcacccaggctagagtgcaatggctcaatctcagctcactggaacctccacctcccaggttcaagcagttctcttgcctcagcctcctgagtagctgggactacaggtgcatgccaccacacccagctaatttttgtatttttagtagagatgggatttctccatattggtcaggctggtctcaaacttctgacctcagcctcccaaagtgcagcctcccaatgtgagccactgcgcccagcccactctttattatatatgtttaatgtttgactccagggactccatcagattcattttgtatcctcactgcctcttagcacagtgcctgctacacactaggtttccaataaatgtgtgaaggtagaaataagaaaggaaagggtgacataggaagaaaaactgtgccataaaaatgttcatgatctgatattgccaatcctggaaataaatctgaagaaaataataaaaaggaagcaaaaagcacatactacaacgcttgtttcatagtgaatgttagctatctctgtatttttgctgtatttttatttatatgtaataaaattggcagtaagttagttatccaggaataggggaggagttagataaatatgaatacttattgtcctatcatgtgcccattaaaaactgaagtaatgcaggccaataaaggtaaggaaaaatacttaatacattttaaaaagcagaaaaaactgtataattacaaccatttatacacatgacaaaagcctatagtattgaaacaaatattataatcacagccatgttaggaaaacagcattctaggtgatttttcccattttcctacattttataatgttatatacatttaataattaaacatttttataggatagcaaataccaaatgtagaggaaaatggatactttcacaaacctctggtaggactgtaaactggttagacctttctgaagggcaatttggcaatatatatcaagccttaaaaatgtctagcaattccatttttagaaaggcttcctaaggaaataattaagaatgcatacaaagatttggctacaagaatgttcctcacaatatgaaatatagttgcaaatagcaaaaaaattagatgtttgtctcccttacttgcaccattaaataaataatggtatgtttacactaaaggatattatgtagcccttaacatgttcttaaacacttaagatgttttcagtaaaaagaagattataaaagagtacatacattatgattacattaaaaacgtgtgtgtgtgtgtgtgtttgtgtacagaaaatggtctcaaagaatatacaccaaggtgttaaacaagcttatctatattcatcttgctttggtaataagaaaaaaataaattcaactttgtacaaacagacttaccaagcctcaaatctgataatcttagggtaggtcatcattatatcaatatgcaacactatagtacaatcgtcctttggtatctgtaggggattggttccaggacttttcttggataccaaaatccaaggatgctaagccctacagttggccctgtggaatcacacacatgaagtcagccctccatatccaagggttctgaatcctgaaaatactgtcctgtcttgtcttgtctttttctttttcttttttttaagacagggtcccaggttggactgcagtggtgtaatcataggtcactgtaacttcaaactcctgggctcaagcattcctcttgccttggcttcccaaagtgctgggattacaggtgtgagccaccatgcccaggcagaatattacattttcaatccaagattggatgaacccatgcatgtggaatccacagataaaagggctggctgcagttttaaacaaaagtgaaaatgggccaggcgtggtggctcacggctgtaatcctagcactttgggaggccaaggcaggtggatcacttgaagtcaggagttcgagaccagcctggccaacatggtgaaaccccatctctactaaaaatacaaaaaaaaaaaaaatagccgggtgtggtggtacgcgcctgtagtgccagctactcgggggctcagacaggagaatcacttgaacctaggaggtggaggttgcagtgagccaagatcacgccactgcactccagcctgggtgacagagcgagactccatctcaaaacaaaaaacaaacaaatgaaagtaaaaatgaaacatttcattaaatttgaaagacatctgcaaaaatggcccagcacctatttgtaaatattaattttgaaacctttagaaatattatgacagagcttaacttgtacctatcagatatgaaggcagataaaccaaacattagccatgattctgagcaccagcacaaagtagcattaataaccccattaataattgcaagtgattataaaatatatttccatattattgtatagtagctatgttttgtttctctttgattagtacatacacttgtctctggatttatgcattaggatgccagttgctgttccaacttacggggactgtacaaacattagttaaattagatacattttgttgaatcttaagtgtacaaaaacactatttgccgaaatatttgctctcaatgtttaaacagtaattatgttaaagagctaattaactaatctataattagaagctagtctaatttatgcaggaaaaaatttctcagtatgggttgattagaatgatgaaatagtttgaaatagtttagggaagtggaggaatataagtagagtcacaatatgcagaagagcctaatttatacagaggagctacagtttagcgtggcttcaaacagagagataaggctagataatcaggtataggccagttcattgagaacattatttgccatctgaaggaccttaatcttatagaagatgaggcaccatcatatagggtttaaactgggtaaggaaattatcagttttgttagatttgcattctaagatcactctgctatcactagtggcagtgcatagaggatggattaggtaaatgtaaaattattttccagtagaattggtatttgccctattaagagcttaaacacttttctcctggaagccaatgttgcagctgctgagtactaattccttgaagggatagttgaaatagtctagagaaaagagatgagagacagacagacagactacacaataagttaatgcttgagtcattgatttatcttcttgtagaatggtagtacctcttcttttaagtagtagtcttacaactaggactggaagctcgatagtagtgtcttccattgaaaaataactcaaaacaaaagtacatataacagtaataactttttcaaatgaaaaatcttcatgtataagatgtacttgttgtattgttaaattttatttatctttggtaataatgttaataataggattgatacagacattcaataacatagatattctaccaggtttgcaaggtaaccaaaactatcgtgttttctgaatagtaacaaattgtatatttagcttgaattttactgttatcatagcaagttttatgtctgtactgtttacagcctgtatcccaaccagttggagctgaacaacaagcagctcttctaaaaccagatttagttcgaaggtaagtatcttcaaattaataccatgagaacaatgaggatatgctgaagtttgtttactcattaggtgcttagtgcatcctgactagagaagcttctgtattcttgtacttgtgtggatgtttaataaagacgatagtttttttttttttttttgcttttttatgtcagtagggatcatatggattgtgaaattaattgatcattttcttattgtgtttatttataccattctgttctaggaaaagctggtaagggttaaggaaggaagaaacaatagagtttagagtagaattctagctaatctaaagaaataaattacaactagatatttaattgtattattatttagtacttgaaaactagtatttttctgtataaaaatatagattggatagtctttattgttctttcttcaagttcattgattgtttcctttgtcctgttcattctactattatgcctattcagtgaggtgtttttttttttctgtgattgtttatttctatactttctatgtggttcttcttaaaatcttctatttcttttataagattttggttttttttcatttgcctcaagattatttgtgattgctcattgaagcattttgatgatagctgctctaaaattattgttagaggccgggtgcagtggctcacacctgtaatcctagcactttgggaggctgaggcaggcagatcacttgaggtgaggagttcaagacctgcctggcaaacatggtgaaaccctgcctctactaaaaatacaaaatttagccaggtgtggtgatgtacgcctgtaatcccagctacttgggaggctggggctgggggattgcttgaatccaggaggcagaggttgcagtgagctgacatcgcaccactgtattccagcctgggtgacaaagtgagactctgtctaaataaataaataaaattcttgttagataattccaatatctgattcatcttgttcttttttttttttttttttttgagatggagtctcactctattgcccaggctggagtgcagtggcacgatttcggctcactgcaacctccacctcctgggttccagtgattcttgtgcctcagcctcccaagtagctgggattacaggctcgcaccaccacgcctggctaatttttgtatttttagtagagacagggtttcaccatgttggccaggctggtctcaaactcctgagctcaaatgatctgcccgcctcggcctcccagagtgctgggattataggcgtgcaccacagcgcccagcctcatcttattcttgttagatgatttcaataactgacttatcttggtgttggcatctgttgattacctttttgcattcaagttgtaatttttctagtttttggtatgacaaaggagtttattttcatttgtctcctgggcgtttggatattgtcaggtgactgtagatcctatttaagtctttttttttttttttttttttttttttgaggcagagtcttactctgttgcccaggctggaatgcaatggcgtgatcttggctcactgcagcctccacctcctgggttcaagcgattctcctgcctcagactcctgagtagctgggattacaggcacatggcaccatgcctagctaacttattttagtagagacagggtttcaccatgttgtccaggctggtctcaaactcttgacctcaggtgatccgcccacctcagcctctcaaagtgctgggattacaggcgtgagccaccatgcctggcctattgaaatcttctatgttagcaagcagtcgcccttgtttagatgcataggttctggcctgcttttgtgggccgtgattctgatgacaatttagttttcaaaatccttacagtgctgctattctggtttgttttgttcacctgaacccctggcccccactgctgggccaagaggtggagagtgcttccctaggcctgctcccccaggtgtgctctacaggctatactctacttactggtggggctcctaccagcggcactggggaaggacagggcctacttaagtcctcttctgttgctgggttggggatcaggagatactgtgcttgggctgcctttgcctctggactgggaattgggagacactgcctgtactgcctttattcactgggtggataattggaagataccaagctgctatgatgttactcaagtcctaggggtccccagccagtccgctttcatcttttcactcttctgtgccctcctgtcattgtctactacattatttctagaacttttagctgtacttagaggggaggagcagggagagttgagtttctgccatcttgtcccaaaccctaaactgatgtgttaagtaactttggaatgtgaatgatatagcccattggctaaaattatattccttttatcctctgattacttgttactgccatttctctgtgtatttaaaaaactcttaagggcagtattaatgtatcttcttccactacttatatttatgtcatacgtcatatggacataaaaaatttaggagttatttttatctcttgtacatctatatatagatgcttcatgagtagtttttaggagaaataacttgcttaaattaacttgaaagatatctatttcaaaaagatgtctgagacttagagcttgtcatttaaattccaaacgtgtttattgaaatttttgtatttgttgaaatatgtttgagtttaaagaaaaacctgaaaaatgcctttgacgcagataaactaaaaggtagcctcccctttcataataatattgatgtagacctgtaaaatgtaactaattagaattaataatgttgagctatttttacatcattcattttcatatcttgttctgcctcctgcagaacactattcttgtctcccatacctggtctaccctgttgagttcattacataaacaagtatattttgagtgataatttgttttggttttagaagttttgtttgaagatattaataaagtaaccaaacaaacaagataaaactgatcaagagcaccctataataaaaggctccacagaggtctatcactggcaatatttttctttcattctcatcactgtgagatggtttgctaaatgctaaataaatacagtgtgaccttgatttttcagctttttaagaaagctttattgaaatataattcacataccatataattcactcatttaaagtgtgtaatttaatggcttttagtatattcacagagttgtgcagtcataacttttaaaaagattgtagtattaatttttcttaaattcattatttatagttttataattgggagtttttcttagaattttactgtcaagactggaatgagttacttttttaaaaatattactagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtcagtttgtaaatatggtttggttaagagtacatatagaggtctggagggtcagagaggggcagtgctgcagaagtgagttgtagaatattgcgagaccctctctaaactaaccttttctccgttacagactttccaatgtgagtattatgtgttcgttgttaaacttaggaaatataagaaagaaaataaaatctacttttaaccaccattcagagatagctcctattaatgttttagtttgtttttctctccttttcctgtatgtacatgtagtgttttacattattgaggttgtaatagtactagtaatcgcagcaaaaatctattgagttcttttgtggtaggcaccctaaatgttatccatgcattttaccatttaatccttcaataaccctgtatgataggtcatagtatatactcatctttacaaatgaagatactaaagatcagaggagtgagccgggcgcagtggctcacgcctgtaatcccaacactttggaaggccgaggcaggtggatcatctgaggtcaggagttcgagaccagcctgaccaatatgataaaaccccgtctctattaaaaatacaaaaattagccaggcatggtggtgcatgcctgtaatcccaactactcgggaggctgagacaggagaatcgcttgaacccaggaggcggaggttgcggtgaactgagatcacaccattgcactccaacctgggcaacaagaacaaaactccatctgaaaaaaaaatgaaatcagaggagcgaagtaagttgcctaagatcactcaactagcaagtgataatgtcagatctgaacctagatcggactttaaagcccgtatctctaaccaatataatgtatgttttagttggctgcttaaacctatatataattttatatcctgcatttttaaaaacctaatatatcatgtatgccttcctgtatcattaatttttcaataacatgacattttaaatggctacattagatagctgcttatacagagaaataacttacattccctatgttcttggtttatgttctttctttccatctttttcccagtctgtcttttttctaacttgctgtcttttactctttttgtctgtctgtatatctttgcagcaaaatccttgaacataaatctttgtatctatccctgattatttccttattagatccataggagacggattcatggatcagaatatgaagatttttaaagtttctagatacatgttgctagattgctgtccataaagattggtccaggttacatttccatttgcagtgcctcttcttttgcttagagtcaatttatagattaagataattttggaaatgaattattaaatttaaatctttgcattgcagatagctctagtgactattataactttttttgctttcttataaaagttgtattgttttctttaccacaggatcacatttataacttattttttactgagtaacttgaacctgttagtttagtcatagaatggctgtttagatggtattccaccaagggaaaacattctgaactatttaagccattttccacatatattgtacgtgaactagtgtagatgttccttgcacaatttgcaaaaagaagacagtgattgactcttaaaccggtaaaatgtttgtactcaggtatcaacctctggagataacatggtagagtgtcagctggagacacacaacaacaagatggtcaccttcaagtttgatgttgatggtgatgcgccagaggatattgcagactatatggtaagtgcagtaagaccaaattatcttcccttcagcattctgtcttttttcccctataattctgtctccatttattttgagccattgttttttagagtacgattagttttaaaattttgtacagaggtaaattgggttatcatcaagtgtaagtcactgcatctcctccggtttcagtatatttaactggaaaatatgcagaggtttcatttagagataatatagctaaatggctcttatctctgattgcatgtgaaaatcacctgacaagctttttaaaaacaattgtattgcctggtcccttgattaaatcagaatatttggaggtgaggcccaagcatcaatagtttgtaaagctccccaggtaattcttttttttttagtttattttttgctgggcacagtggctcatgcctgtaatccccgcactttgggaggcctaggcaggaggatcacttgagcccaggagttcaagaccagcctaggcaatgtagtgagtgagaccttgtcttcacaaaaaattaaaaaatgccagatgtggtggccacacttgtaatcccagcactttgggaggctgagggaggaggattgcttgagcccaggagattgaggctgtagtgagctatgatcatgccactgcattccagcctgggcagcagagcaagaccctgtctcaaaaaaaagttaccttttattatttttattttttataacaggctttgaaaaagctaaagccccaggtaattctttttctttctgtttttttttttttaatttttgtggctacatagaaagtttatatatttatgaggtacatgagatatttcgatgtaggtatacaatgtgtaagaatgatgtaaaggtaaatggggtatccctccccttgtaattctaatgtgttagtcactgatctaacatcttgcatgttattgtttcatttagtttttaatattttctttgaattgttaggtttaagttagtatttcttccccccttattttattatttttttttattattttctaggttacttttccatcttccccttttttgatggggatgggactaggatggcaggaagagtgcatataatgctttttgtttctgccagctttctttgtgtatgcatttctagccaagcagaattaaacattttaaaagttaattatttcatcatcagttctgttcttgtttaacgtaatattttctgaactgtctcttctttcattcttttcaggaatgtttaacctaattagtggtcttccgagctattttttttttttttttttgagacagagtctcgctctattgcccaggctggagggcagtggtgtgatcttggctcactgcaacctccgcctcctgggatcaagtgattatcctgtctcagcctcccaagtagctgggattacaggcgcacgccaccacacccagctaatttttgtatttttaacagagatggcatttcgccatgttgaccaggctggtctcgaactcctgacctcaggtgattcacccacttcagcctcccaaagtgctgggctaccgtgcccagccttccgagctattctttattttctttggagatgtttcattttgtggtttgtgatttaaaagcttttgggtttggacatcttagttttaaacattgcctcagttatgttcttcaaataaccaatttatagaatgacatattttttaaaatgctggttccttctctggtaggtagtgccaatctgagaaatgtcagtagtctcagaataatttaatgtattttttggcattttattgctggtctttgtgaattctattgtgacacttggatttagatacttaattttaattttattcttctttttctttttcttttcttttctttttttttttttttttgagacagagttttgctcttgttgcccaggctgtagtgcaatggtgcaatctcagctcaccataacctccgcctcctgggctcaagcaattctcctgcctcagcctcccaagtagctgggattacaggcacccgccatcatacccagttaattttgtatttttagtagagacagggtttcaccatgttggtcaggctggtctcaaattcctgacctcaggtgatccacccacctcagcctcccaaagtgctgggattacaggcatgagccactgtgcctggcccaattttctttctttatgtgatagtcactatttatataatattataactttgaagaaactgaattcattctcatgaatagacttacttttgggcaggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccaggtgagaacaattgtttagcaaacagatcttctcagatatgaatcaggaactttttaatttatctattcatttttaattcagacagggtcatctgaacaagtacagataaattctacatctactcaaaccagcagtaagtatatttagtaaaatttatcatttggtttttgaagcaagacatttgaaaacttttaacacaccttcattgggaaagatgttagccaataaattaatttggtaacttattagtgtaggttttctcacactttgaaaggcccaaaggtaataatccatcccctgacttttccccaagtgttggttctttatctgattgatttatttttgagttattgggtggtcatgttaccagaaaagcagtcacagtactgatgaccttaaatggcataactgtttgaaacttaactggtaagttatttttttctgatttgagatggatagaaactttttaacaaaagtcatcattttctaagtttgcctcatatttcaatagtcattcgtatcttgattttattctactaacgatgaatgatatgcttctacttgcgctggtcactgataacttttagtaaatcagataccagataaacttccagaagcgaaaactagggtctcctgttttcttttctgatgactttatctttccattcttctcagttctggtcatgggtatattaaagagtgtctgggagggggataagagccatagacaaatgagcacccctgaagaaattacaggaacgtaaagaagcaaaaggtggtgtgggagtaatagaaccagataccattatcctgaaatttagtttgactgtgttaggatgcagtccttcctatatcttatttttctggttagccaagatatgagtaggtttctgactaacaaagttgggtagagtttaaaagagaattacttatttgagtacatttacaaagtagcagttaagatgtaggggtttattttactttattttaaaaaatgtcatacagtaaaactgattttcttttggtgtacacttctgtaaattttaatacatgtatagatttatataagcactatcataatcaggatacagaataagagatataggttttaatgagaaaagtgctgtcagttttttcaaagagtaccctgtttctaattgctattcaagcaatatttgtttcagtagaatctaaaatccttctctaaagatattgtgtgcttagtactttagactttttgtcagtattaaaagggctggtcttatcaattacatatattctagtactattagaaatggagatataagacaaattgtttatttaacctggcttcttcagtcaataaggtaaataaattgaaaatagcttagcatattattttttgctaattatttctgcagatgaatctgctcctcagtcatccccagttggtcggtggcgattctgtatcaatcagacgataagaaaccgtgagactcagtctcctccttctcttcagcattccatgtctgcggttcctggccgacatccacttcctagtaagcttttcttctctgccagctttgtccagactcaaaggatgggatgcaaaatacatatgatatctttaactggtttccatgggaattttatgcttatgagaattttcataagcttttttgaagacattaatattaggatacaacttaagccatttcctatttaatatttatgagaaaaaaggaaaacattatttcccttgacaggttgaattctgtgttttgagtcttatttacgagagtactttcacacaggttctcatttgcccctttgtcctcctgttccttttgacttagggtactagtctgtgctttgtactcgtcagtacgtgcttagccattctttattattgttccaggtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgtaagtatcattctttctaaccaattccttactctttgcttattgttttaaagaaatgccttctcttctaaaattctgtcctttgagatgaaatggtctatgtcacaagatgctgaggtcacaggtatttaagaaggctatgacttaggctgcaggtgttcagaacctctcagtagagatgacaaactatctttggtaagagagccctctggtgaattagctaagaacttgcaagcagtgtctatatttgtattaatgacagaatgaaaactgactcatggattgttttagtgggtaggaagaacttttagattttcacttaaaatgccagttatccgtttccttctttaaaaaaaaaagttatggtttttaatttaatcatgtttggggggatttaatttgacaaaaaaagagaagaaaagaaagtaaaaatcatcattaataccatgacttttttttttttttaaaccctagacggagtcttgctctgtcgcccaggctggagtgcagtggcatgatctcggtctgcctcccgggttcaagtaattctcctgcctcagcctcctgagtagctgggattacaggcacgtgccaccacgcccggctaattgttgtattagtagagacggggttttaccatgttggccaggctggtctcgaactcttgacctcgtgatccacctgccttggcctccaaagtgctgggattacaggcatgagccactgtgcctggcctgacttattttatgagttatataatgtaggaactttaattttccttttctgccccttcaaatcacaaaagtaaccactaataatttgatgcttattcttcttgacttttcttaagcttatacagatctatttacatacatataacattatattcataaaaatactgtgctgtatacatactgttctgcaacttaattttttcattttacagtagatcatggacatctttctaaatctttattgctgtatctttttgtcatttttgttattatataagtaataatatatacttgtacatagtatatatgtactacgtacaagtaaaatccaccccatccccaaacctgtagacacagctgttaacaaatctttccagacatgattttaattaatatacaaatatttataaagacatactttttatatatgatatattgtatctttatatagatatagatacatgttaatatttatatacatatacttatttacatatatgctattctgcatttttttcatttatgggtatctatccatgtcagtacacatagttccatcttactcaactttttgaaacaactgcataatattccactgatacatataatttaaagatttaaaaattttttaaattattttaaataataaatatcacataatgtgattcgaatcttaagaaatgaactgttatttctgtcatttaaactttgttgcttgaaggagactctcccaagtgtcaaggtcaaatgaattcatttatttgtttcaagtgtctgttgctatatctggatcatacttagctgccactgtttctggtgtcatggaattcttcttttttcccctaaaatacttctatgagtaatattttcaaatatattgcatgagtatcctatttggtattcttttgcatgtccaaaaatgtctttatattgcttcacacttgattgactaagtacagatggtaggatcagaattttttcttctcaatttagaagacagtgttttattgtcttttattagccttcctgatgagagtgatgtcagttgtttatcattcatttgtaggtaacctgtttttactctagaccactgcaatgctcttgtactttttacaacgtggaaatgttctgtatctgcactatccaatacagtaaccactaaccagatatgactattgagcacttgaaatgtgactagtgcaactgagggcctgaatttttaatttaatttaattaatttaaatttagacagccacatgtgattagtggctactgtattcagttagcacaggtctagttgctcttagggaactatcttagagctctgattatcagactgtatcttggtatatcactttcccattcattttgtatatcacttttgtggatgtttcgaatttgaagatttgtgtcttttttcagctccggtaactattttcatttcttttttttcttccccttcattgtcttgcttatttccatttagaaattgtaggagatatatggcctcttggattattccccatgtttcttaacagcttgctctcacttttaatttcattttttaaaaccttatgttctcagatatgtcttcagttttttttttctttttaaatttcagatcactctcttggtattcagctgtatccagttaatttttcatttggcagtcatgaatttgattttttaaatctttcttattcttggctccattttcatagcaacctatttttgcatatatttttgttccaagcttttttctcagaaaactgacaaaatattaactctaaaatatataaagaatgcttacaaatcattgagaaaagatcagacaactcagtggaagaatatccaaagcatctgaacgtgcatttcacagaagtggaaatataaatgcctgctaaacatgtgaaaagattttcaactttcttagtaatgagagaaaggcaaaattttatggaaaaatagttttttgctaatcagactagcaaatattaaagaaattgatggctgggcgcagtaattttcattttatgttggtaggaataaaatcagtacagcctacttggagggcaatttaacactatgaaagttagaaatgtgtacattcctgtgactgagctatgtcactgtcaaattctacctgagagaagtatttgcacatatgaacaaaggaacatgtataagaatgttcagtgtaacattgtttgattattggtaacaggaaaggattcacaaacaagtttaaatatttgtaaatagaaattgagggacactgatactatgaagcaatttaaaagcatgaagtagacctataaatatatgttagctattatcatctttattttagcatggacatatctccaggaaaaatcatcaggaaaaatatatgcagaataattcagacagtatgatgaggtgtgtgtatgtgtgtgtgtgtgtatatgtatgtatgtgtatgtgtgtgtgtgtttttgagacagggtctcactccattacccaggctggagtgcagtggcatgatcgtggctcactgtaacctcaacctcctgagtttaggtgatccccttgcctcagcctcccaagtagctgggactacaagtgcgtgctaccatgcttggctgatttttaaactttttgtagagacatgggcttgcagtgttgcccaggctggttttgaactcctggcctcaagcaatgctcctgccttggtctcccaaagcagtgggattacaggcatgagccaccacacctggcctgtatttttaaaaaggaacacacacacacacacacacacacacacacacacacacacacgcatatatatgtacataaatgcacaaaaaagttctgaaaagataaattgatattagtggatatcttccaggggagactgggaaggagggttgttacagggatttttgttttatctaatggtttagatcttttacagaaaacagttattcatgttataagccaaaaaatatctaaggcagatctcaatcaatttagaattttattttgccaaggttagggacatgcctagaagaaaggaaacatggaatcacagatacagtctgtggtctgtgcctttctccaaagatgattttgagggcttcagtatttaaaggagaaaagcaagctggaggggaaagagggaggttatggtaatccacatgttgcaagagaaaaggagcaggtaggagaataatcaattatgtattcatctcccaattttgctcagtaaatcagcactttacataagataaggtgaacatagggtagctacctctggagatatttaaccttttatttgtagctgtttgcttaggaacaaaatgaaatgcagtttcttgcatgactcagctttcagcttaatttttttctttttggcatagtgaattagggtcctgagtttttgttttcctttcacaatgtaatacttgtaatattttttaaatgaaaacattcttattgaaacagtgttagaaagaaaacagcttttgaaccccacaaaccagtttcaaaatcttgctttgccatttactatgtaatactaggcaaattatctacaccctttacccagccttaatttcctcatctgtaaaatcgagataatagtacctacttaaagggctactggatgcctttggtatattctctttattgtttattcatcttatttcatattctttgtgctctataaatatggaaacttgtcttgtgatttcttagaattttaactcttttacagtgttcgatccagtgacattaaatttgttcacaaggttgtgtatccatcaccattatctagttccagaactttttcatcaccccaaaaaaagaaacttcatacccattaagcagtcattattcattctcccttcccccttgccccttgcaaccacaaatctgctttctgtcagtatagatttgcttatgctagatatttcatataaatggaaccatacagtttatggcctttgtgtctggtttctttcacttagcataatgtttcaaggttcatattccattttatggctatactgcattttgtttatccattcattggtttgtggacatttaggttgtttctaccttttggctgttgtgaatagtgctgctacgaacattcatataaagtattcatatgagttcctgttttcaattatctggggcatatggtaattctacgtttaactttttgaagaaccaccaaactcttttctaaagcagccacaccattttacattcccaccagcacaatgtgagggttccgatttgtccacatacttaccaacacttgttttccaattttttgatcatagccatcctggtaagtataaagtggtatcttattgtggtcttgatttgcatttgcttaatggctagtggtgttgagaatcttttcgtgtgcttgttggccatctgtatatcttctttgaagaaatgtctgttcgagtcctttgcctattttttaattgggttgttgtttgtgttgttgagttgtaagaattcttttttttttttttttttttttttgagacggagtctcgcactttcgcccaggccggactgtagtggcgctatcttggctcactgcaagctccgcctcccgggttcacgccattctcctgcctcagcctcccgagtagctaggactacaggtgcccaccactgcgcccggctaatttttttttttgtatttttagtagagacaggggtttcaacgtgttagccaggatggtctcgatctcctgacctcgtgatccgcccgcctcggcctcccagagtgctggaattacaggcgtgagccaccgtgcccggccgtaagaattctttatatgtgtggctgggcatggtggctcaagcctgtaatcccaggatttagggaagccaaggcagtaagatcgcttgaggccaggagttcaagaccagcctggtcaacatagtgagaccccccatctctataaaataaaataaaaaaaatctttgtatattctggatgctaagtctttattagatattttatttgtgaatattttctcccattctgtaggtttgtcttttcactgtcttgatggtatcctttaacgcacaaaagttcttaattttgttgaagtctgattatccacttttccttgtattgctttgttagctcttataattacgtctttgatatatgttgagttaatttttgtatatgtatgagacaagggtccagcttcgttcttttgcatttggatatccagttgttcagcaccatttggtgaagaaactattctttcccccatttaatggtcttggcattcttgtaaaaaatcagctgactatatagatgtatggatttatttctggactaattcaattcatcactcccaatatctatccttatgccagtagcaaaatgacagtgttttgattactgtagttttatagtacatttggaaatcaggaaatgtgagtcctccaactttgttctttttaaatattttttggctattcagagtcccctgtgattccatatgaattttagtataagcttttctattcctgtgaaaaaggccattggggttttgatagggattgcattgaatctgtaggtcactctgtggactgttgacagattaagtcttcctgtccatgaactttctatttatttcagtatccttgaatttctttcattgatgttttgtagttttcagtgtataagactttcactccttggttaaatgtattcctaagtattttcttattgttattagaaatggaattgttttcttaatttctgttttggattcttcattgctagtatataaaaatacaactgatttttatgtgttgatgtatcctccaactttactgagtttgtttattagctccaataacttttggtggattattttggattttctatatataagagcatgtcaactgtgaatagagatagttttatttcttcatttcccatttttatttttcttatatacaaactttttttttttttttgagatggagtcttactctgtcgcccaggttggagtgcaatgggatgatttcagctcactgcaacctccacttcccaggtccaagcaattctcctgcctcagcctcccaagtagctgggattacaggcgctcaccactacgcctagctaatttttatatttttggtagagatgaggtttcaccatgttgaccaggctggtctggaactcctgacctcagatgatccacccgccttagcctcccaaagtgctgggattacaggtgtgagccactgcgcgcagctcttatctataaacttatgcttttcatttgtttgtccttttgctttttgtactgggataatttctcaatttttaagcggttgcatctcctattcagctattttttgtatcaagtattacattgttttaatttctagtaactgtagttcattcctttctttatcaatgtagtatattcacacatctctctgaatatattgaagtcttattctgtgttattaatgctatttccttggctattctgtttgccgagtttagtattttcttataatgttagttttcccttggtgtttagtgattcttagttgtgttctcttctttttcactcatgagattccttgttcatctgtctgtaagtgttttatgtaattaccgtaactttccttcagtaattgtgggaaaggtatgggacatgctccctggcactgtattttgtaacttatctctaatgctgcctggagggtggcccagtagctagtctccaaatgtaggagggcttacctttcttcctggatgtcgtctccttcctacatcgttgacctctttcttggccacaaaaccttttcctcttactgctcttatttgggggcgcatgcctctgctgccctttgcttggtctggaggtggggagagaagggacagaactgcctgcctgttccttctttgttatcccaaccagttcattcttccattcagtaaatatctctttagcagtgaataagtcaaaacctctgtttttgtggagtttacatctagtagaagaaaatggatactaaacctatatatggtagtcagggaaagacttgtatgtgatggtgacagtcataggcagagatctgttcaaggaaccaaaaggcggccagtaaacaggagagcattaagagataacattgaaagagacagaagatagatctgatagagttttgtaagcattctagcctaccactcatctttttagttggccagggttctctcctgctgcccgtatcagccactcaggtttgcagcattttgaaacaattcctacatatgtcatggtctactttttcctctgtcagtcatatatgcatgtgtctatgtatattttcctgttgtgtctgtaaatttggattgataaggaaggctagaacaaatatttaatttgccatcttgatccagttactacatattaaaattcttttctgtaatttcagtgggaccaatgtaacattttctaaattgtaatactgatttttttcttctcatgaaactaattattactagtttaaaatgagacttcagaaagtaaaaactgattgcttacaattttatttttaatatgtcctgacctgccataagtttgtgtttgtttttttgtttttttttttttgaaacaagagtttcgttcttgttgcccaggctggagtgcaatggtgcgatctcggctcattgcaacctccgcctccgggttctagctattctcctgcctcagcctcccaagtagctgggattacaggcaggcaccaccacgacaggctgattttgtatttttagtagagacggggtttcaccatgttggccagtctggtctcaaactcctgacctcaggttatctgcccacctcagcctcccaaaatgctggcattacaggcgtgagccactgcgcccagccctgccctaagtagtaataatgcttacccaagacatcatacttactgccatgtaggctatcttctttcaggcaaatgctaaatcccattctttgtgcttttatatatttttttaatcttctagattagtagtgacccttctcatgtttcccaaaatatttgtggttgtctgtgctaacttttcatattaattattataggggatttatctttaaagcactcatttagatacaacagttatatctggggcccttttgcggggagtagaaggacaagaagaggggattgattttatagccagcatagcctgacgttaacaagaatttttagagcatgattttgaagtaattttgatgtcctttataaatttccctatgctttcataaagtaagaaacttgatttcctgatacttctctgtaaatctaagtgcctagatatcttgtttttttctgtttttatgtgtttcaagcatctttaactgagtctcttaaataatataggcataaatgaaaatttccatgataatagcatggagttttagtaacctttttagtaaactggcacatatgaaggaaattttaatttgattttcagttttcaaagtttgtataatgatgaaaaatattctggggtagaagattaataatcttctcttttatttactaaagtctaaataatatttttaaagaaacaaggctttttataaattgagtactttgggttcagtctgatatgctactattaatgcaactatatacgtaatactctattttgggttaaagattagtctatacaagaaattccgtttttttttttttttaaaagcttcaccttacctaaattattaccactttggtttttctcggttgttttgttttgttttgttttgttttgttttgttttgttttgttttgtctccattaggagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaaggtagtgtgcttacagtcagggacatagactaggtaacatcacttttcatttacttattttttttgttgttcatatacaaatcttgccactttttccacatagcccatgtatgtgacatgtcccattaatgtcattgccattttattttttccttttgtaactaatttggttttccggttattcatttcatatagatactaagtcttgggataaatcttgcaatgtctgatttagacttagggacttaatacaatgttgcttattacattaacaccttttaattgtctagcaggagttaagctttttctacttttcttcatttttggtaatgtaaacaaatttagtcttaacaaacaattttctcttttttacttacaatttggcaaaacttgcagtggaaacagaagagatgagatcagcaattgctcctgatcccattcctctgacacgggagtccacagctgatactagggctttgaatagatgtaaagcgatgagtggatcatttcagcggggtcggttccaggtttgtgtctttgattgaatccttatctacaagggcattataaaatataacagccagtggagatcttggtctgtagatgatacttccatttttgtttttatttttttttgagatggagtttcactcttgttgcccagttggagtgcaatggtgtgatcttagctcactgcaacctccgtctccttggttcaagcgattttactgcctcagcctcccgagtagctgggattacaagtgcgcgccaccacacccggctaattttttgtatttttagtagaaacggggtttcaccatgttagccaggctggtcttgaactcctgacctcaggtgatccgcctgcctcggcctcccaaagtgctgggattacaagcatgagccaccatgcctggccgatgatacttactttaaatgtagatcattgtcatatttaatttgttcatcttgcatgcatcccctcaccttttgaagccatcagtaaagatgaatctaaagaaatggagattttcatagctggtagagagcacagaaataggttttcttttggcgggtgggtgggtcctcttttataaatgtaatttcacgtcctttagaatctcagcaactctaattgtggaattttatttgagcaatatgatgcccactctctttacccaaggggcctgattgaaagagtgaatttgggggtatagattaaatttttaagttttgctagtatcaatacatatacatcacagcagagcatctacttgtctgtgctatgctaaccacttttacgtttttatatctcaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaagtaaggactgtttctcttttgtcacaaatctggttgccctaggttttatagaacttagtattggattggtaactaatttaggattggtgacattttaatgattgaaaactacaaagaatgctaatgctaaacatttatgaatgagaaaaagttcttatatataaaatgttttcatagtctcaagactattacagttgcttatttaccaatatgatttaactactctttttgctaacctttacaatccttattcttcaggacttttggttttagattttacaactattcttatataatttcacatttgataagtaaacagctgatttattataatcagagatagtggttcatcttctttaggaaaaggtaagatactttcaagatcaagcttattatttggtgactgaggtaatcaaccttcactagtgatattatgataatatattttgtcaatagaatgctgttttgtatttagttttataaaataggtcatttaaaaaaaagaaattcaggccagctgggcatggtggcgcatgcctgtaatctcagcactgtgggaggcagaggcaggtgtatcacttgaggtcaggagttcaagaccggcctggccaacatggtgaaactttgtctgtatttaaaaaaaaaaaaaaaaatacaaaacttagccaggtgtggtggcagacgcctgtactcccagctacttgggaggccgaggcaggagaatcgcttaagcccaggaggtggaggttgcagtgagcccagatcgtgcgccactgcactccagcctgggtaacagagcaagactccgtctaaaaaaaaagaaaagaaattcatatttaagttgctgaattctaattctatccacatggttcaaaattcaaaaggtacaaaagggtaaccagtagtctccctcctagcactgcagctgaactatccaggttctctccttagacacaataaatattacctgtttcttgtatatccagttagtctataactgtacaaacaaatatgcatatttcattctttgttccccaaatagtaacttacactgcaagactgttcttatatcttggttttctttaccatttcatagtatcttggatatatatctgtatcattatatttttgactgtttcaaagtattccattatatgtatatactcataagttaattactagcctcctattgacgaccccatgcccttactttgaaaagttgaaaccaactctagcaatttttgaatatatcttatgctttagagaatttccacactgttctgggacttgaacaatttgtaaagcagggagaaccagggaggactaaataggcacgcaaaaagctggatttggccagacacagtggctcatgcctgtaatcccagcactttaggaggccgaggcgggtggatcacctgaggtcaggagtttgagaccaccctggccaacatggcaaaaccccgtctctactaaaaatacaaaaattagccagacgtggtggcgcgcacctgtaatcccagctactcaggaggctgaggcagggagaattgcttgaaccttggaggcagaggttgcagtgagtcgagatcgcaccactgcactccagcctgggtgacagagcgagactccatctcaaaaaataaaataaaaagctggattttagtcaagttcttacaagcttgaataatgctccacttggatgctacgttcaagtgcttcaagaattaaagcaggttaaaatccttggaaatttcttagtttctagggccttgcccagagaagaaaaaaacccaaaactgtcattccaatgatagataattataatattttctctctaacttgtttcagtgtttttaacttgagcttgcaagaaaattgtgaatatatactttaaatattcatcaccagaaggctgatattccactttaaaatatatatacaggcttgacattacattatgtatacgtcaacttatatattaagtactatacagtatatgtacactgatactttttataataaaagttattaaagcagtttcatatttgtgatataagtattctattgcttttgttttgttttggtttggtttttttggttttttttttttttgagacggagtctggctctgttgcctcagctggagtgcagtggcgtgatctcggctcactgcaagctctgcctcctgggttcacgccattctcctgcctcagcctcccaagtagctgggactataggcacccgccaccacgcctggctaattttttgtatttttagtagagacggggtttcactgtgttagctgggatgatctcaatctcctgacctcgtgatccgcctgccttagcctcccaaagtgctgggattacaggcgtgagccattgcacctggccttctattgctgtttttaatggttcttttaaaccattgtcaaatgactggtagcttttgtagctggctagttttttgtaactgggtggttatgaatatctacttaattttgaatgtgagacatggattctcataacctcatagaacccaagacctggaaaggatcttttattttgagacagagtcttactatgttacccatgctggagtgcagtggtgcagtcatggatcattgcagcctctacctcctgggctcaagccatcctcccacctcagcttcccaagtatctgggcctacagacgtgtaacacatccagctaatatttaaatttttttgtagagatgaggtctccctgtgttgcccaggctggtctcagacttctagcctcaggccatcctcctgtctcagcctcccagagtgctgggattataggcatgagacaccatgcctggcctagaagggatcttaaaagataatttattcatccttcagtgttcttttagcattatggtttcttcaccgatttttattattctttcttttattactattacaattattattattaagatgaggtcttgctctgtcacccaggctggagtgcagtggtgctgtcatggctcactgaagccttgacctctggctcaagagatctacctgcctcagcatcccgagatgcttgtactacaggcacgtgccatcatacctggctgatttttttttttttttttttcagagagacagggtctcactatgttgtctaggctggtattgaactcctgggctcaagcgatcctcctgccttagcctcccaaagtgctgggattacaggcatgagccactgcgtctggcaaaaaatgttaatattattaatactatttgactttacattttgttttactgactttcactgtatttcagttttagaaatttgttaatctttttcttcatgagtgattattacagttaaatgttatgcttaggaaggcatttcccacttcccctccggaaattgtgaaaatactctgtatttcctccttccttccttccttccttccctccctccctccctctctctctcgctctctctttctttctttttttttttttgacagggtctctctctgtcacccagtctggagtgcagtggtgtgatcttggctcactgcagccttgaatacctgggctcaagtgatcctcccacctcagccttttgagtaggtgggactacaggcatgcaccaccgtgcccagctaatttttgtatttttttttttttttttttagagagatagggtcaccctatgttacccaggcttgtctcgaacttctagtctgaaacaatactcctgcctcggcttcccaaagtgctgggattatggatgtaagccattgtgcctagtctctatttccccattcttaatctaaattccttgttaaactttacttatactggtttagagtttcttggctcatctttatggagccagtgccattaaaatgctttttgcatgattttcattcagacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacaggtaaatcagtcataaaagtaatttttaaaaaatctagtccaagattagcaaaattagtaaaatgattataatacaatttatttttaattaggctaaaataatttaaagaagtacacattattctgagattattttctgtttttgatgttaaatgtccttttatgtagtaatgattaggataattgatagattgtaaagagaagctgagtatggttcatgcttttatttggaaaaccagcagctggaagcccaatgccaatccccacaataatttttgaaatgttatcagtcagtgggaacttctggtctagcatttagagtttgttggagagtttgttggtaacaagataatcttaaaattatactcggccaggcgcagtggctcacgcctgtaatcccaacactttgggaggctgaggtgggcctgtcgcctgaggtcaggagttcgagaccagcctagctaacatggcgaaaccccatctctactaaaaatacaaaaattagctggatgtggtggcaggcgcctgtaatcccagctactcaggaggctgagatgggagaattgcttgaaccctggaagcagaggttgcagtgagccgagattgtgccattgcactccagcctgggcgacaagtgcgaaactccatctaaaatacatacatacatacatacatatatatatatatatatatatacacacacacacacacacatatacacagacacacacacacactcaacaagaatgaaactccgtctcataaaaagaaatacatacatatatatacactcatgctcttatctgaagagatctttattagttataagaatattagtaaaatatacttctttgactttgaaaaataagagcatcaatctctacttaactaatatagaagttgttaatcaggtcaggcctctttggttatatgtgcatagtcaaggtgggggttaaggatgtattgtaaggacatatgtgaaatcccaatggaacttgtcgtaggcagaataattccccccgaaaacgtccatgtgcaaatctctgaaacttgtgaccatggtaggatatatggcaaaggagaattaagcttgcagatgggattaaagttgctaatctgctgactctaagatagggagattatcctggattatccaggtaggtccagtgtaaaatcactaggatctttaaaagtagaagagaagaaacacagaagagtcagagaaaagggaaacagtgtcagaaaggtgcaacattgctggctttgaagatggaggaagagtgccacagaccaaggaatggaggcaacttctggaagctggaaaggccagggaacacatctctcctatagccttcagaaggaacacagtcctggcaacaccttgattttaggccagtgaggcccatgttaggcttgtaacctagagaactataagatcaatttgtgttgtttgaagccactaagtttgtggtaattagttacaacaacaatagacaactaatacagaacccaagaaaaggaactgtacttggatgatcttgtaaagacagaattaaggggtagacttagattgaaggcagctctggggatttaatagcagaagtacatgaaccttcagtctgatgcagtatcactaatagctatactttattttattctgtttcattcccaaatggcttcattttatgcatagtttctgctttcccaaaactgttagataacactggttactcgtgatcccaaagcattctttcactttcaggtccttatttaactgacctttgttagattccagggacagaaaatttgactgtccctgctcatctttttcatgccaagaaatgggtcagagcccattgcctggcctatagttgggctgttctacagtcaggtgtccacctgtttctaagtaagcatggccagagaagtatgatctcatggtaaaaacatgtctctggaggctgtctttgggattcctcaacttattttgtgttataatggatgtaccacagtttgtttatccattcatcggttggaggacatttgggttgtttctagtttggggttttacaaataaagctcccgtaaatagtcacatacagctttttgggtgaacataagttttcagatcacttggatgaaatacccagaaatgagattgctgcatcatatggtatgcatatttaacattttttaaaaactaacaaaccattttcccaagcagctgtatcattttacattttgtcagcaatgtgcgagacttccagtttttctgatgctcttcagcacttggtattactagcattctttttttagccaatccaataggtatttgatgatataaagtggttattttattataattttcattcccataatggttagtgatgttgagcattttttttcttgcacttatttgtgatctgtatatcctctgtggtaaagtgtttgttcaagttttttgctatttttttgtatcctgttttatttttaattgaaattttcattgagataattgtcgatttacatgcagttaaataatacagagagatgctatgtacctatgtatcctttactcagtttatcccaaaggcaacaatttttgtcattttagaaaattaggttgttggttttcatatggttgattttcgagagttttttctgtatttttgataaaaatcctttgtaggacatgtgatttagaaatatattattcaagtctatagcttgtcttttcattctcttaacagtgtcattggcagagcgaaagtttgtgattttaataaagtatactttatcaaattttttttaaaaattgtgattttggtgtaatatttaagaactctggctaaacacaggtcacaaagattttcctctatgttttctcctaaaagtttaatagttttatgtttacatttagatttatgacacatttggaattactttttgtatgaggtgtgaggttttgggtgaggttcttttttgcatattgatattcaattattacattaccatttgtggaagagaccgtcctttctccattgaatagcttttgtacctttttgaaaaatcaattagccatatatgtgtcaatctctttctggactctttattctgttccaattaatctatgtgtctgtcctttcaccaataccacactattttgattattgtagttttatagcaacttttaaaattattattgttaaaattaggtattatgtttcctgaaactttgttttttttcaaaactgttttagctactctacttcctcttccttttcatataaattttagaatcagcttgactatatctaaaaaaatcctgctgtgattttgattggaattatgttaaatctatatatcaattttggggagaattgacatttttactgtgctgagtcttccaatcaataaacgtaggctatctctccttttttttgtctttttttttaacttttattttaggctcaggggtacatatgcaggtttgttatataggcaaattgcatgtcatgggggtttggtgtacagtttatttctccaggtcttcttagatatgttttatctgctttttatagttttcagcttacagattctatatgtgtttcgatttatttatacctaaggatttattttatttctacagggtttccaatcacacattgatagagaaatatgattaatttttgtgtatcgaccttacatctgaagattttgctaaacatatttgttctagaagttttcttatagattctttgggattttttgagtgagcaattatgtcatctgcgaatatagacttttttgtttctccctttttaatctttatgccttttatttcttcttactattgtactagctaaaactttatattggacatccttgccttgttcttccaaggagaaagccttctgtcttttgccataaattataatgttaactgtaagttttcgtatatgccctttattaatttaagttcaataagtatgttggtttacagttttcatctttttgttttatattttgaaaattttgatactatctttttctggtttgatatcagggaaaagctgccttataaatgagttggaaagtaagtatttcttttgcttctttacttttaatttttttaaaaaattacagttttattgagatatttcacatatcataatgttcactcatttaacttatacaatttacagacttgtgcagctattaccacaatttgattttggaatattttcaacattccacaaagaaacatgtacatattcatagtcatccctcattgtagctcctctaccccaaacccccaaccacaggccctaggcaaccacaaatctgctttctgtttctatagatttgcctatgctgaaacattttgtatcaatacagttacacaataatatgtggtttcgtgactggcttcttttacttataatgtttttgggagtcaaacattttataacatgtatcagtacttcattttttattgctgtataatattaaaatgtatgtttatccattagaacactttcatcacctcaaaaagaaatcccttttctatgagtagtagcccccgccatttattcccacttcccccatcctccagcctcatcaatcactaaagtattttttgtctctatagatttgcctgctcttttttgggaggccaaggcaggaggattgcttgagcccaggagttggagaccagcctgggcaacaaagtgagaccccatctctataaaattagccaggcatggtggcgcacgcctgtagtcccagctactcagaaggctgagacaggaggattgcttgagcctaggaggttgaggctgcagtgatccgtgttcacgccattacactccagcctgggcaacaagcaagacctgtctcaaaaaaataaaataaaataaataaaataaaataagatttgcctactctggacagttcatgtaaatggaatcatacatcatgtggtcttttgtgacttttttcacttagcatatatttacaaagtttaactgtgttgtaacatatattggtacttcatttctttttgttgccaaataatactccattgtatggatatgccacattttattcattcatcagtgattacacatttgtgttgttttctcttttttttgctattatgaataatgctgctatgaacagttgtgttcaaatttttatgtggacatttgttttcatttctcttggatagatatgtaggagtggaattgctagatgacatgggaactctatgtttaatcttttgaggaattaccagactttttttccaaaatagctgcaccattttacagtcataacagcaggacatgagggttcaacaactcaacaataaaagattcaaaaatccaattttaaaatgggcaaaagattcaaataggcatttttctaaagaagatatatgaatgactgataaatacatgaaaagatgttctgtaatattagttattaaggaaatgtaaatcaaaggcacaatgagataaaactttacacccacttaaaatggctgaaatttaaaaaggcaattcccaaggacataggacatatgaggcgaaaaaaagaaaaaaaaatttttaagacagtagcaagtgttggagggaatgtagagaaattgttgagttgtgagtaaggactagagccttactgaatatgattttgcaaataatcatctcctattcttagattgtcttttcactttcttgatagtgtcttttgaagcacaaaaagtttttaatggttttaaaatctaatctgtttcttttcttttgttacttgtgcttttactgtcatatctaaaattccgttggctcaccattgactctatagtaattgaaaagaaagagaaaaaagaaaaaaaatctattgcctaacttaaggtcatgaagatttattcctataatttcttttgtttgtttgtttgttttgtttcgttttgagatagagtctcactccgtcgcccaggctggagtgcagtggcgcgatctcggctcactgcaacgtccgcctcccaggttcaagcgattctcctgccttagcctcctgagtagctgggacacaggcgcgtggcaccacaccccactaattttttatttttagtagagacggggtttcaccatgttggccaggctggtctcaaactcctgacctcaggtgatccgcccactttggcctcccaaagtgctgggattacaggcatgagccaccgtgcccggcctattcctatattttcttctaggagttttatagtgaatctcttacatttagttctttttttttttcttcttctttttttttttttttttttgagacagagtctcaccctgtcgcccaggctggagtgccgtggcacaatctcagctcactgtaacctccacctcccaggttcaagcgattctcctgcctcagcctcctaagtagctgggactacaggtgcatgccatcacgcctggctaatttttatatttttagtagagacagggtttcgccatgttggccaggctgatctcgaactcctgacctcaggtgttccacccgcttcggcctcccaaagtgctgggattacaggcctgagccgctgcacccggctacatttagttctttgatccattatgagttaatttgtgcatatggtgtgagttaaagatccagattcttttttttttttttttttttttttttgggtatgtggatatctccttgtcctagcactttttgttgaaaagactatttttcccccattgagttgtcttggtacccttattgaaaatcaactgaccagaaatggacagatatatttctgtaatcttaattctactccgttgatctctgtgtctggccttatgccaatcccataccatcttgattcctatagtttatcatgtgttttgaaattgtaaattgagttctctaaatttgttcttatctttcatgattgttttgactattctgggtaatttgaattttcatgtaaattttagaatcagcttgtcaatttctgaaaaaaacagttggaatttagagtattgactctatatatcaatttggggagtattgttatctttaaaatgttgtcttccaatctgtgaacatggtatgtctttctgtttattcagattgtctttaaatttctttctttctttttttttttttttttgaaacagagtctctctctgttgcccaggctggagtgcagtggcatgatctcaacttactgcaacctctgcctcctgggtttaaacaattctcatgcctcagcctcccaagtagctgggattacagacgtgcaccaccacacctggctaatttttctatttttggtagagacagggttttgccatgttggccaggctggtcttgaactcctgacctcatgtgatccacccacctcagcctcccaaagtgctgggtttacagtcgtgagccaccacgcccagccaggttgtctttaaatttctttcaacaatcatttttagtttttagtgtataagttttgtgcttattattattattattattattattttgaggcagggtctcactctgttgtccagggttgagtgtagtggcatgatcattgttcactgcagcctcaacctcctggtctcactcaagtgatctttctgcctcagactcccaagtagctgggactacaggcacatgccaccatgtcctgctattttttttttttatttgttttagagacaaggtctccttatgttgcccaggctggtcttgaactcatgtatgctaaagaaaagtatgtattctggtgttgttgggtggagcgttccatatatgtctgttaggcctctttggtttagagggctgttcaagtcttctatttctctgttgatcatctgcctagttctatcagttattaaaagtgggttatagaagtctccaactggcagggcacggtggctcacgcctgtaatcccagcactttgggaggccgaggtgggcggatcacaaggtcaggagatcaagaccctcctggctaacatggtgaaaccccatctatactaaaaatacaaaaaattagcccagtgtggtggcgggcgcctgtagtcccagctactcgggaggctgaggcaggagaatggcgtgaacccgggaggcggagcttgcagtgagccgagatcttgccactgcactccagcctgggcgacagagcgagactccatctcaaaaagaaaaaaaaaaagaagtctccaaccattgttgaatttctcccctcaattctgtcaattttgcgttgtgtattttggaacacacttgcacacatatgtaataattgttatgtcttcttaatttatatttcattttatttggctgaaggagaattattattattatttgtccagaaaactcaacagtctacatttaacccagcttaatgggaaggtgttttttttttttttttagatggagtttcgctcttgttgcccaggctggagtgcaatgacgtgatatcagctcactgcaacctctgcctcccaggttcaagcgattctcctgcctcagcctccctagtacctgggattacaggcatgtgccaccacacccagctaattttgtatttctagtagagatggggttctctatgttggtcaggctggtctcaaactcctgacctcaggtgatccgcctgcctcagcctcccaaagtgctgggattacaggcgtgagccactgcgcctggccaatgggaagttcttaagcctttgccttttccagcttggcaatgagagccagagattttggacccaggatattgcctccctagtgacagtggatctcatcctgtctgtcattgtcattggttctgatggcttccaccagcttagccaaagctcctttgtctgccaagttaatctgtgtgaaggcgacagtggtgcaagtcttcctgtggactagacatcccagtcttctcttccctttgtattttatgatgcagggcaggcaggaagacagctagctctatgagatccattgtcacgtgcagtcaccaccagctgagctttcttgttctccaccaaggtggtgacagcattaatccctgctcaaaggccttagtggagacatccctctggcaactttcttctcagtctggaccaatgatcttcttgctttgtctctggtctgtccttataggccagcttaagcagttgtgtagctatttggcagtccaaggcctaggtaaactggttatttgcaggaggcactttcagctgcttttagaagatatatagatccttgctgctgcaacctgatatagcagggccatctgacaaagtgggtgaggtccctttagggctggatgtcctgttcagtgccaaaattcttaggccttttctcaaacgggattcatcaccttcttcgcctcctgcttcctcacaatagcaggagagggggccatcttcttccacttagccttcattccttttggcattttgaatggctagaggagagattatttctgatattagtacaaccaatccagctttcttttggttactgcttgcatgccatatctttttctgttcttttactttgaatgtatttctgtctttaaatcagaattgtgtttattgttatcatatatagttaaatcatgttttttattctgtcaatctgtcttttgattggggcatttaaatcatttccatttaatgtaaggtaggatttatgcctgtcattttgttatctttgttttctatatatcttcgatttttttctttttttcctcatcctctgactctccgtattcctgccttcttttatgttaaatagatattttccaatgtagcatttaaattctattgtgtctttttttatatatatatatatatatatatattattattattattattattatactatacttttttttttttgagacagagtctcactctgtcacccaggctagagtgcagtggtgcaatctctgctgactgcaacctccacctcccgggttcaagtgattcttctgctcagcctcccaagtagttgggactacaggtgcataccaccatacctggctaatttttgtatttttagtagagacgaggttttgccacatcggccaggttggcctcaaactcctgacttcaggtgatctgcccacctcagcctcccagagtgctggaattacaggcgtgagccaccatgcccggcctattatactatacttttcatttttcttcttttttttgagacagggtctcaccctgtcacccaggctggagtgcagtggtgtgatcatagctcactataacctcaacctcccgggctcaagttatcctcccacatcagcctcctgagtagccgggaccataggcgcatgctaccatgctcagctaattaaaaaaaaaaaaatttttttttaaatacaggctctcactgtattgtccaggctggcctcgagctcctgggcttaagcaatcctcctacccagcctcccaaattgctggtattacaggtgtgagccaaagtacctggccctatattattcttttcttatatttttcagttattttcttgtggtagccacaatgagcttcttaatttaaaagcaatctagttcagtttttttgtgtgttttttgtttgttttgagacgaagttttgctcttgtcgcccaggctggagtgcaatggtgcgaccttggctcactgcaacctccgcctcccaggttcaagcgattctccttcctcagcctcctgagtggctgggattacatgtacctgccatcacgtgcagctaatttttgtatttttaatagagacagggtttcaccatattagccaggctggtctcgaactcctgacctcaggtgatccacccgcctcagcctcccaaagtgttgggattacaggcgtgagccaccacacccagtcatgtttttttgtttgtttgtttggttggttggtttttttttaagatggggtcttgctctgttgcccaggctggagttgagtggcgtgatctcagctcactgcaacttctgcctctgggttcaagcgattctcctgcctcagctacctgagtagctgggattacaggcgtgcgtcaccatgcctggctaatttttttgtatttttagtagagatggggtttcaccatgttggccagactggtctcaaactcctaacctcaggtgatccgcccgcctcggcctcccaaaatgctggattacaggtgtgagccacctcgcctggcctctagttcagtttaatactaaattaacttcaatggtacacaaaacatttctctaatatatgtgtgtgtaatacatacacacacgtattccctcacaacttctttgtactattattgttatacacattacatctttacatgttataagctcattgacacaattttatagttattgctttatgcagttgactttgaaatcaggtaggaaaagtagagttataaatacaaagtacatttatactgaatattatatttacctatgtagttctcttcagcagtgtgctttattttttcatgtggatttgagtaactatctagcattcttttatttcatcctaaaggactcactttaatatttcttgtaagttaggtcagctagcaatgaatttccagttttttattagaagtgtttctatttttattttttttccatttatggaatttgtttttaaaaaacaaggacataaaggactagcttaaattggatcaaaggctgttaaaggtcctggtacaattcaccttataaaacataaggtatgagaaagtatgcctgtgttttgtttggtgagtagaaaataagaaggaaattttggtgatttccaattcaagtgtgtcactgctgtgacagcttccagctcacagaaacatctggtattcttaataccttctattctggcccaggttaaatttctttaattatatacaacaagtagaatcctattttaataggaactctaaaatagctagctatttaaaactcttctctttattgatgcttccttttcagccataaagttgatagaaaaaatactgaaaagtacaaaattgaaaaaaaattattttgcttaataagtctattaataaagttttattttatgcaataagacacctaaaaatttgaaaggcaaaatcattcttgtaaaataaagccatttggatttagactttctagggttttgggaaataatgtaaaaaaataaagattccatttgttttgtttttgagacagggtctgaccctgtccctcaggctgaagtgtagtggtgccatcacagctcactgcagcctcgacctcctgggctcaagtgatcctcccacctcagcctcccaagtagctgggactacaggtacacactaccatgcccagctaattttttttttaatagagatggggtctccttatgttgcccaggctggtctacagcttctgagctcaagtgatctgcccacatcagcctcccaaagtgctgggattatttaggaaaggtcttattctaaaaatgcttggttcaatggaaattcagattttttagtattctttgtattccagtcatcaagaagaactagttattagaatgagcattgaaagtataaagttccttttgcatgttcccaagagttagtcatcttccatttttcaaatcttttttacaacaaatattttgcttttgatacttaacattaggtctctgaaataaagaataggtaaacaaaagagtaaatctagaggcatggctactttactgttataactggttatttccaaatctcagttgtatataccttatccacttctcccctggtatatagactagcttttatccacctttgaactctcacaactgaacagttggctcccaaaagacagtgcacagtttggtgcccttaactctattacatacttttcacaagacacacttcttttcctatagattaaaattcacctatagaaaactgttactcattttcttaaaacataacaatctccaactacatgcagagcatgatgtctatgagaaggtcaccctcttcaaggagtttatagcacagtgttatgtgtggatctccttcctttttttttttttttttttttttttttttttgggagatggagtctcgttttgttgcccaggctggcgcgatctcggctcactgcaacctccgcctcccgggttcaagtgattctcctgcctcagcctcccgagtagctgggattacaggtgcccgccactaggcctggctaatttttgtatttttagtagaaatggtaccaccatgttggccaggttggtctcgaactcctgacctcaagtgatctgcctgcttcagcctcccaaagtactgggattacaggtgtgagccaccgtgcctggccgggtctccttcatttttgaaagatttaggtgaattcttctttgatagtcttactctttcaacactttgacagtgtcatcccattgtcttttggcctgtatggtttccaatgagaagtcagctcttaattttattgaagtcccttatacatgacaagtctattttttgtcttctttaaagattttctttttgtctttgattttcatcaatttgattatgagtgtctaggtatggatctcattaaatttactttagttatagttcactgagcttcttgaatgtgtaaattaatatttgtcattcagttttggaaatttggagttattatttattctgatattttttctgcccttttctcttctatttttggaactcctattatgcatatttgtcatgcttgatggtgtccaacaggtctgtgaggctctttcacttttttaaatttttttattttttattttatctatctatcaatttatttatgagacagagtctcattttgtgaatttatttatgagacagagtctcactttgttacccaggctggtgtgaagtcgtgtgatcttggctcactgcaacctccgcttcccgggttcaagcaattctcgtgcctcagccccccaggtagctgggattacagacgcgcaccaccacacccggctaatttttgtatttttagtagaggcagggtttcaccatgttggccaggctgatctcgaactcctgacctcaagtgatctgcctgccttggcctcccatagtgctgggattacaggcgtagccaccacacccggcctctttcttttcttttcttttttttttttttttaattcttttttctttctgttcttcaaagtggatttcttcatcaacctgttttcttgttggttgattatttctttttcccactaaaatctcttaatgggcccctctatataatttttcacttcagatactgtatttttaagctctagaatttgctttttaaaaacaacttccatctctagtctctatttggtgagatattgttgtcacactttcctttaatttttttaggcatagtttccctaagtttggatatacagtttgtcccttggtatatgcggagatcagttccaggactcctgcgtatgccaaaatccacacagtcaagttccacaggtggccctgaggaatgcacatatatacaaaatgtcagccctccatatatgcaggtttcacatcccagaatactgtattttcgatccatatttggttgaaaacaatccacatataagtggacctgcacagttcaaacctgttttgttcaagggtcaactgtatttataatagctgatataaaagctttgtctactaagtccaaaatataggccccctccaggatgtttttgttgggtccccttttttcctgcatatgtcatgctttcctgtttctttgcgtgtctcttaattttgtggtgcaaactggacattttaaataatatattaaagaacttctagtatcggattcttctacccctcaagggttgttgttgtttttcttgttgctaattatttagtgattttcctggacaaattttacattccctgcagtgtatggccattgaattccctgctggattttctttttcaaagagccatggctggagtgtagtggcatgatctagttcactgcagcttcaaactcctgggctcaagcaatcctcctacctcagcttccttagtacctgggactaataggtgcatgccacaacacatggcaatttttttttttttaagagaccaagccttgctctgtcaccagactggagtgcagtggtgtgatctcggctcactgcaacctccgcctcctgggttgaagcaattcccctgcctcagccttatgagtagctgggaccacaggcacacgccaccacacccagctaattttttgtgtgtattagtagagatggggttttaccatgttggccaggatagtcttgatctcctggacctcatgatccacccgccccaaagtgctgggattacaggtgtgagccaccgcgcctggcccacatggctaattttttttttttttttttttgatggagtcttgctctgtcgcccaggctggagtgcagtggtgcaatctcagctcaatgcaagctccgcctcctgggttcatgccattctcctgcctcagcctcccaagtagctgggactacaggcgcccacgaccacacccagctaattttttgtatttttagtagagatggggtttcagcgtgttagccaggatggtctcgatctccgacctcgtgatctgcctgccttggcctcccaaagtgttgggattacaggcgtgagccaccgtgcccggcccacatggctaatttttaaaatttgtgtaaagatggggtcttgctatgttgtccaggctggtctcaaactcctggcctcaagagatcctcttgcctcagcctcccaaagttctgggattacaggcatgagccaatacacctggcctccctgttggatttgtttttatttatttatttttaatttttaagcctggtttcccaaggttcacacctgggctagtgccgtttagtgatgagccatgattggtcagaagagttcactaagtgccttgcctggatatcttttccaaagggatctctgttagagatcaaacttcagacagtttgtaagacaacctttgatttacttcctgcttgcctaggaactcaaggtcaaccagaagtgagtgattggcaccttctcctttcttaggtctttcgtgggcatgccagacttttatattgccaagaatatgttagaggttttcaaagtttcttatggtcatctagttctcccagaattcccttttaattctagtctaggttcttatttgccccaactgaaatctcagccttaggcagctgagttgttgcctgcactttcccatagtttcagtaatgccttgcaggtagccccctactctccatcccactatgctcttccactgccaggtgagcagagctttgagtgaaatcaaatctccaccacacttgggaaatagaaatctttccagggtgctgcaaaatatatatatatatatatatattttagtatttattgatcattcttgggtgtttctcggagagggggatttggcagggtcataggacaatagtggagggaaggtcagcagataaacatgtgaacaaaggtctctggttttcctaggcagagggccctgccgccttccaccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaagattatagattaacagcatcccaaggcagaagaatttttcttagtacagaacaaaatggagtctcctatgtctacttctttctacacagacacagtaacaatctgatctctttcttttccccacatttcccccttttctagtcgacaaaaccgccatcgtcatcatggcccgttctcaatgagctgttgagtacacttcccagactgggtggcggccgggcagaggggctcctcacttcccagacagggcggcggggcagaggtgctccccacatcccagacgatgggcggccgggcagagacgctcctcacttcctagacgggatgacggccgggaagaggcgctcctcacttcctagacggggtggcggccgggcagaggctgcaatctcggcactttgggaggccaaggcaggcggctgggaggtggaggttgtagcgagcggagatcacgccactgcactccagcctgggcaacattgagcactgagtgagcgagactccgtctgcaatcccggcacctcgggaggccgaggctggcagatcactcgcggtcgggagctggagaccagcccggccaacgcggggaaacccgtctccaccaaaaaatacgaaaaccagtcaggcgtggcggcgcgcgcctgcaatcccaggcactcggcaggctgaggcaggagaatcaggcagggaggttgccgtgagccaagatggcggcagtacagtccagcctgggctgggcatcagagggagaccgtgcaaagagggagagaggagacggagagagagggagagctccagggtgctgcaaaatattgactgtgcactggagatggtgtttttttttttttttttttttttgagatggagtctggctctgtctcccaggctgcagtgcactggcacagtctcggctcactgcaagctccgcctcccgggttcacaccattctcctgcctcagcctcccaggtagctgggactataggcacccgccaccacgtagtggcgtgatcttggctcactgcaagctccgcctcctgggttcacgccattttcctgcctcggcctcctgagtagctgggactacaggcgcccgccaccacgcctggctaattttttgtatttttagtagagacaggggtctcaccgtgttaaccaggatggtctcgatctcctgacctcgtgatccgcccacctcagcctcccaaagtgctgggattacaggcgtgagccaccgcgcccagcctggagatggtgtttttaagggagctcaaaaagaggtatgattgctccattgtctgcagtgctgctgtttgttggctaccacaacgctgagctggggaacaagggggaatgagaattgccccaagtcaaagtgtcacagatgccagtagtttccatagtttgtctttcatagaggtttttagttttattctatggctttggataattgtcaggggtggttggttctagttgttttgcctatatttttattgtttttgaatacaagaaagtttacccaggcccttattctgcatttttagaagtccatcttctccttccttttctattttctgaagagtttgtcttgagttagtattatttcttctttaaatgtctgggaaatttttccaatgaaaccatctgggctcagagatttcttttttgggaggtttttaacttttcaaacttttggccaggcttggtggctcacggctgtaatccaagcactttgggaggccaaggcgggaggatcatctgaggtcaggagtttgagaccagcctggccaacatggcaaaaccccgtgtctactaaaaatacaaaaattagccaggtgtggtagcggtggcacgcgcctgtaatcccagctaccagggaggctgagacaggagaagtgcttgaacccaggaggtggaggttgcagtgagctgagattgtgccactgccctccagcctgggtgacagagtgagactccatctcaaaaaaaaatttttttttcaaaaataaatcaaactcttcaatagtagttacaggattatttagattacgtatttcatgttgggtgagtttcggtagtttgtggttttgggggggacttgttccattttgtctatgctgttgaatttttgtgtttacagataatatgaacattatatttaatatctggggaatgacgtcacctttcattcctgatatttaatttgtcttctctttttttctttgtgattcttgatagaagcttatcaattttatctttacaaagatccagtatttgcttttattgatgtttttctctactgttttcccattttaaattttatggatttctgctctttattattttctgccttctacatgccttgtggttattttgatcatttttttcccctagtttttttttttttgtttgtttttttttttgagacggagtctcactctgtcgccctggctggagtgcagtggcgcgatctcggctcactgcaacctccacttcccggtttcaagcgattctcctgcctcagcctcccgagtagcagagattacaggcgcccaccacttcgcccagctaattttttgtatttttagtagagactcggtttcaccatgttgaccgggctggtcttgatcttctgaccttgtgatgcgcccacctcagcctcccaaagtgctgggattacaggtgtgagccaccgctcattatctcttatttttgtcctttaaaatcatttgggaggccgaggcagcaggattacttgagcccaggatttcaagaccacccctggcaacatagtgacaccccatatctacaaaaaatttaaaaaaaaaattagcccgtcatggtagcgcacacctgtagtcccagctacgcaggaggctgaggtaggaggattgcttgatcctgggaggttgagacttcagtgaacagttattgttattgcaccactgcactccatcctgggtgacggagtgagaccctttttcacaaaaaagaaaccaagatttgagtgcttgaggtatcattgcttctaggccctcttagctgataaggaactatacatgtgtatactaacatatatatacacacacatatccctacctatgaatatttctatatgtaatcatctgtatttatattaaggtaaatttgcattcatattgatgtctccaactctaatccattaccacatggatcattctgcccttatcgacttatctatttgcttatctgtaacctcccactccagaagtgagaaacctggctcccaccatcctccagccatttacttgtttaattccagtgtacaggtatcgtagtttcagaattttaacccaaaccctagtgggaaatacttttataaagtaaaatacaatgcttatgtacagtttcttttgccttcagtattacaggtgccactcatttccaaagttatatatagttcagcatctgttcttttacccgcttatatgaggttgcttcatacattttcaatatgattagatgctttcatcaaattctacattcccttctgggattccctgacctcctaaattgctttttaaacttgcatatattaaggttcattctttgtgccttttctgtgcattttgacaaatacattctatcctgggatctcatgacctcctaaatgatttttttttttacctttgcatacattgaagtttattctttgtactccagtattccctaggttttgatatattatattttctttgttgttgttgttcttgagacggagtctcgctctgtcccacaggctggagtgcagtagcgtgatctccattcactgcaagctctgcctcccggtttcacgacattctcctgcctcagcctcccgagtagctgggactacaggcacccaccaccatgctcggctaattttttgtatttttagtagagacggcatttcactgtgttagccaggatggtctccatctcctgacctcatgatccgcccgcctcaacctcccaaagtgctgggattacaggcgtaagccacagcacccggccctatattttcttttttttttgagttctaaatgttttctaatttcccttgagacttcctcttttatccatggattattggtagtgtgttgtttaattttgaagagtttggagatttttctcattgtctctttttttttgaggcagagtctcgtcctgtcacccaggctggagtgcaggggcgcaatcttggctcactgctacctccgcctcccgggctcaagcgattgattctcttgcatcagccttccgagtagctggggctacaggcgcccgccaccacgcccggctaatttttgtatttttagtagagacgatgtttcaccatattggccaggcttgtcttgatttcctgaccttgtgatcctcccgcctcagcctcccaaagtgctgggattacaggtgtgtgccaccactcattatctcttatttttgtactttaaaatcattatggttagagaacatccagtcagtctgagatatgtggagtttttttttttttttttgagacagagtctagctctgttcccaaggctggagcgcagtggcatgatcttgactcactgcaacctctgcctcccaggttcaagcgatcctcccacctcagtctcccgagtagcttggattacaggcacgcatcaccacacctggctaatttttctatttttagtagagacaggatttcaccatgttggccaggatggtctcgaattcctgacctcaggtgatccacctgccttggcctcccaaagtgctgggattacaggtgtgagccaccacgctcagcctgacatgtggagaatttatcaagtccctatggctatctcacttctcagatctccctgttaacctcaggctaatggagtacctgcttctaaagttctaaatcaagtgaatcccctatggtagcagcaacagcagccaaacttactgttttctcagaatgccccactttgctgggcaacagagctgggtgggggtgatgggaacagccttgtgcaaaaacaccacagattgcacagttcttacctgaaaagttcagtagttttcacgaataaatgcttctgattttgttgtattccttaggacaaattctggagtactaaagtgattgtttttgaattttgtccaattttaggattccttttgagggaggtttcttaacgtcctcactctgtcatactggaagccagaaattattttttttcagtaggcaggaaggagagtatctgattattgtacttctgttaaattaacttatttattaaaatatttagatgggttccaaaccagactttgttatttatctatttattttttagagacagggtcttgctttgtcacccaggctagagtacagtggctcagtcatagctcactgtaacctcaaactcttgggctcaagcaatcctcctgcctcagcctcccaagtagccaggactataggcgtgtgccactgtgcctggcaaatcttttttaaaattttttttgtagagatggggtcttgctatgttgcccaggctgatttcaaactcctgacctcaagcaatcctcccacctctgcctccagagtcattgggattacaggcgtgagccactatgtcaggccctcgaaccagatttaatataaaaatggtcatgtcttcttaagtaggaactaaattatcttcattttctttttctttttataactcatggaggccaagttcacaaagacaggatgctccacatgtaccttccagtagttttgttaccttattgcctctcacaggaacaggtgatttcatatttctagctccaatagtgctctttcaaaacttgctgacatttcatctttttcccatttggccaagattggtggacacatttgttggccttagcacagcatttcataagttgtcagcagggagttaataggtgttacatggtcaaatgcgaaatgtggtattaaataatataaataccagtctctccactgtagaatttcttaggtcctttaatgtgctaatatgaattgagaatgtccaagaaaggaaataatatacaaaatctcccaaaacaattttaccagggaacccattttaggaagcagtgcttggccaggtgcggtggctcatgcttgtaatcccaacacttggggaggctgaggtgagcagatcacctgaggttaggagttcgagaccagcttggccatcatggcaaaaccctgtctctactaaaaatacaaaaactagccagacgtggtggcagacacctgtaatcccacctacttgggaggctcaggcaggagaatagcttaaatccaggaggcggaggttgcagtgagctgagatcacgccactgcactccagcctgggtgacagagcaagactccatctcaaaaaaaaaaaaaaaaaaaaaaagcactgcttaacacgtatatatccttccctgcccacaattatacatgttttgttggaaacatgagttgatacatggtattgctatgtttatttatttatttatttatttatttatttattttttagacagagtctcactctgtcacccaggctggggtgcagtggtgtggtctcggcccactgcaacttctgcctcccaggttcaagtgattctcctgcctcagcctcccgagtagctgggattacaggtgcgcaccaacacgcctggctaattatggtattgcaatgtaatggtatccacaatgtatgtgtgtagttaacttataatatgagcattgtagtaaactgtacagaatagagccaacctaacagacatgagactgctatctttagacaggcctgctggcaagattggcccttggctggtatgtgggaacttggtttccctctgttccctaaccggtaaatagttcagtttgcctggtttgttggtacaaataatgtgatttatcctgaacacatgttttcctcctcagagtctggaattttagtacgtgcctctgagaccagcccccagtgaaaaccatggtcactaagtctctaatgggctttcctgggtagaaatgtgtacacctgttgctgtatttttttgttgctggagaaaggatagggagagaacatatggaagtctgagcatgaatttctctagactcctgtcttttccctttgctgaccgtaatgtgtatctttcactgtaataaaccttagctatgaatacaactatatcttgagtccttggagacctggtgaatcactgaatgtgtgggtggtctgggagatcccaagacataataaaaatattgcatgtgttaggctgggcgtgtggctcatgcctgtactcccagcactttgggaggccaaggcaggcagatcacttgagctcaggagtttgagaccagcctgggcaatatgtcgaaaccccatctctacaaaacatacaaaaattagttgggcatggtggcacacgcctgtaatcacagctactcagaaggctgaggtgggaggattgcttgagtccaggagtgtgacagagccagaccctgtctaaaaaggtatatattgggccgggcgcggtggctcacacctgtaatcctagcactttgggaggccgaggcgggtggatcacgaggtcaggagattgagaccatcctggctaacacagtgaaaccccgtctctactaaaaatacaaaaacttagctgggcgtggtggcgggcacctgtagtcccagctacttgggaggctgaggcaggagaatggcatgaacccgggaggcggagcttgcagtgagctgagatcgcgccactgcactgcagcctgggcgacagagcaagattccatctcaaaaaaacatatatagtatatattatatatattatcttaatcctcagaacatctctgtaaggtagataaatattaatgtttgtcttttttaggtgaagagactgaggttagtgaggttaagtaacttcttttggatctcagttaataggtgagagaatccaaatctgtctgacttcaaagccttggcttttaactattatactgcattgcttcccaaaaccataaattttacctgtagtgggttgaggggaatgaatgatgatagtggtctgagaatgcttcacgcagaagataggatttgagttggtctcaaaggataaatgggctggccaggtgtgcagtggctcacgcctgtaatcccagcactttgggaggctggggcgggtggatcacctgaggtcaggagtttgagaccagcctgaccaacatggtgataccccatctctactaaaaatgcaaaggatagccgggtgtggtggtgcacacctgtaatcccagctactcgggaggctgaggcaggagaattgcctgaatctgggaagcggaggttgcagtgagccgagatcatgccattacactccaggctgggcaacaagagcaaaactccatctcaaaaaaaaaaaaaaaaaaaaagataaatgggcagaattgaaattaagggaagtggaaagagtattgtcaatagatagaatttcatgatattaaggcatgcaaacggtaaaaatgcaagatttgcaagaaagacatgtaactttcaaatagttgggtgaaatggaggatttacagtagaaagttttccttctgtacttaaaaaaatttggcagctgccacagcatgtttctgttagtgtttagtgtaagataatgaatctgatctaaaacaattatatatttaagcttaataagtgatacatgttagtttaaggataataaataaaataatgtacttgttctgcaaggacaaccatgatttcccaggtctttgccacctaaacaagtgggaaccctcatgctgttagcagtaaagaactgttgaagctttttttttttttaagcagcattttatctgaaaacagcatttcactcatattattttttacttatttattctttctgagacacggtcttgctctgttgcccaggctggagtgcagtggcaggatcttggctcactgcaatctccgcctcccaggttcaagcaattctcctgcctcagcctccaattagctgggattacaggtgtgcaccaccatccccagctaatttttgtatttttagtagagacagggtttaaccatgttggtcaggctggtgtcgaacttctgacctcatgtgatccagccacctcggcctcccaaagtgctgggattacaggcatgagccaccgtgcccagccttcactcatattaatctggtggtagtttgaagaatatattggctagagccaaggagtgagtccatttagatcactgcaatcatagtagtctatgcatgagataattaagagcttatagaatggtagaaatgaaagtggacaagagacattgtataggaggaatttcatgacgtagtgatggactggagatttgtgtattggtggggagatccaaaggatctgagtttgagtggtttggaaaaaaatgcagtatcttaaacagaagtatgacatttaagcaaatcgtcatgccaggattgtgataggtttgaccccaggtatattgacttgaattatttattttttaatttaatttttttagagacagggtctcactgtcacccaggtaggaatgcagtagcgtgatcatagttcaccataaccctgcactcctgggctcaatcaagcctcccaccttaacctcccaagtagctgggactactggtgtgtgccaccatgcccagcaaattttttttgagacgagatcctcctatgttgcccaggctggtcttgaactcctggcctcaagcaatcctcctgtgtcagcctcctaaagtactaggattacagatgggagtcaccatgcctggcctgaattgaataatttattaacatccaagtagaaaaatacatttgggaattggttgtgagattgtgattgaagagagaaatcaaggtataggataagagatagaaataatgcagtggagtgatcactgaaactgtctgaatataggcatcaccttggaggaaagaacaaaaaagaacatcaaggactgaactctggttttattcatttcatcaataagaaatgaatattaaagagcacatttgaagttaatatgttattactacctatcataaaccacgtttgcatagtacttattttaatgtgcattgattgggtattttctggcttgtgagctttgaattaagtggtcttttatattatgatatgaataacttttaaatgaaatcagtaaataaatgatcctgctttatgtaaagcatagatactgaataacattcaaatagcatttttttccttttcatatggcacattgttcttcataactttgtgtgtgtttgtgtgtgtatgtgtgtgtgtagttgttctttctgttgcctgcttaagagacacggtcttgctttgtcgcccaggctggagtgcagtggttgttgccctagtccctgtttcatttaaatacttgcttcagtttgttaattattttttcctccacttgttggctattgtgccactagttcagcagccttaatttactgccaattgagtatttaagataacttgttagaccagagttatacacaagaagagtcctaacattttatttcccttagtggagaaatgttcttttttcatttctcttctttttctccctcccacccagaaatgttcttttttttgttgtttgtttgtttggttggttggttggttggttggttggttggttggtttggttttgtgtgtgtgtgtgtgtggaatctcactctgtctcccaggctggagtgcagtagcgtgatctcggctcactgcagcctccaccacccaggttcaagcaattctcctgcctcagcctcctgagtagctgggattacaggcacccactaccatggccagctaattttgtatttttggtagagacggggtttcaccatgttggccaagctgctctcaaactcctgacctcaggtgatccacctaccttggcctcccagaatgattggattacaggcgtgagccactgtgccagccccagaaatgttcttaaattaatgacatttagacctaacctctctgcaacaaatgctttagaagctgaagggattgggcacaaaaatatttctaagagaagacggataggcaaaactgtgggcattgatacattcctgtttctggctatcttctctttttaattctacctgctgacattcttctaggttgagaacacagtctataaaagcttaggctctaaagtcttccccaactttgttgtgctctttgctccctcgctggaataagcagagaattagttgaatgtgcaaagggataacaagaagaaatgatacttttattatagactgacttttgtgtctcaggattttatgtcttagaaaaattgggattccaacaagttagtatgtcattttgatatatcatggttgccccaaattagtaaatgttgttttaaaactcttgtatatgtgaatgttctgattaattcattaaactcttcttatacaacactactgtgtttccctttgatatttaaggctgggtgcagtggctcacacctgtaatctcagcactttgggaggctgaggcaggcagatcacttgaggtcagaagtttgagaccagcctggcaacatggtgaaaccccatctctaccaaaaatacaaaaattagccgggcgtggtggtgtgcgccttgattccagctactcgggaggctgaggtgtgagaatcgcttgaacccaggaggcagaggttgtagtgagccaagatcgcgccactgcactccagcttgggtgacaaagcgagactctgtctcaaaaacaaacaaaaatatttaatcacctttgaatctaaattttcagtagcacagggttcatagaaaatcacagactatgcatatgcaatcattgagattgtcatgtttccctttattaagtaatatcttcttccatttcctactttattatatcagttggcatttattttattgtattattattattctttgagacagagtcttgctctgttgcccaggctggagtacaatggcgtgatctcggtacactgcaacctccgcctccctggttcaagcgattctcttgcctcaaccttccgagtagctgggattacaggcgcacacccccacgcctggctaatttttgtatttttagtagagacggggtttcatcatgttggccaggcaggtcttgaactcctgacctcaggtgatccgcccacctcagcagttggcatttatgatggagtacaacggaaagcccactgaactgacagtcaggatatctggattctagccccagcatatgacgccagttgttaatcttctgggtcccagttttactgtctataaaacagaatgacacttgtttatatcacaggcctgttataagtttcaaaaagtattaatatggaagcttcttgcattacctcttgcaattttttttgtattttttcatgattaaaagaagtaccataacacatgtataaggcatcttcacatgcttgttaaatccctggaactgttattgtgcttaaatttacaactgtatttcctaaaattaattttagaaccactctgtaagtttttggcttataattcagtcagaggaattggaactctatgaatatttcctgtaagaatgatatcataagcatgagtaatagtactcaattatcatgtaaagacttagtgtgatgttcagattaggaaagtatacttatggaattctctgtaattgatttctttcatttatttgaacatcttatgctccacaactcatgaggctcatcaaaccatctgtgtcttcatttctgctattctagatacacattcatctttttaaatcgtaaacagaaatatcggtaaaaaataaaatgagattctagttttctgaagcttcttaaaagtcagtatggtacattgaaaagatagagtgtctttgtctaggctttagagttccaggcctgtctctgctggtaattagttgcaagaacttgggcatgtcagtttacttattctgggccttgttttcccattataaaagtggcttgcactagacctttttttttttgtttttaacattatttgattcttttttaatctttaaagtatctatctgagggagctggtgaaaagattagagtttatactaatttttatgagtactatttattacccttgatttatacctaaggtaaccatataatttgctgtccaaacaagaggaaacttttttttttttttcttgagacggagtcttgctctgtcccaggctggagtgcaatggtgtgatctcagctcactgcaacctccgcctcccgggttcaagctattctcctgcctcagcctctcgagtagctgggattacaggcgtccaccaccatgcctggctaatttttgtatttttagtagagacagggtttcaccatgttggccaggctggtcttgaactcctgacctcgtgatccacccgcctcggcctcccaaagtgttgagattacaggtgtgagccactgcgcccagccaagaggaaacttttgagagtgaaagggagtactgttagcaattactccaggacaacagctttaaaccaggacgacgcaggtaaactagagtgtgtgttcaccctaattgcaccccatgtgtggctctgttaactgctttgttggccaaagagttatctgattatcagttttaattctttttcatggtttccctgttgttgttttttttgtcttatagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaagtaagttgtttatacccaattcactttgtttacaagaactaaaaccataaaaattgatgcgcttaggcctatagttacagtcactatgagagagtagtatgacttgataacatagagacttttatccttttttagattcattatgtctttgagcaaattatattttagaccatgagtcagtaaacttttggggggaaggagccagttagttaatattttaggcttttcaagctatactattacaactacttaactctgttatagtgcaaaagcagccatagagaatatgtaaccaaatgggcatggctttgttccattaaaaccttatttacaaaaagaggtggtgggctgtggtttgccgacccttgttttagactgttctatttttttaaaaaaatccagcaagtatcaaagaagaaagcgtctggaatgaaggttaattcagtccagtgtttcaagaagagtttgggttttaaggaaaagttttcctgtgtttcacgtcaatattcttagatctgataagttatttgttcattatgaaaaagaactttaaagttatttaaactggaatattataagaggtgttttaaagaaaagatgcctagttattgcatgtggccttagtcaggtgtacatgcaatgaagtgaagaaagatgcccacaatgcattctggagtaggaagaagtcaggcttacagaacagcacacatagtataatataatttatgcaaaattatatacattagatatgcatagagaaatatgaaaagccatgaaaaatatgctggatggtggaatttgggccttattctactttgtacatttctgtgtttttgtatttttaaagtaagtgacttttttttcaaaatgagtaaacctattaaaatggaatcagggcttataattttaaccctcttaattgaaagagatttatctctgtgtgttacatttgtgtacatgtattgtcatatgtgtacatgtatagtcatatagtttgttaaagaaataatgcatttattgttaatattgaataaaaattttcaaaatcctcgatttcccaagctagtgagcagtatatctccttgggagctctgtgtatttatcttacttgtggcaccaatttatacacagatagcatcaccattgtaaaaattggaagcctttagaggcaaatttcaagacataaatgcatttgtactgccagtgagagaacctctgagtactgtgtgaatggaggcttttgttgactagttggagggctgtttactggagtataatggaggatgtttggaggaagggtgagtagaaaatggtgtgtgaataaaagtaatgaacgtcatttaacagacttgggttccaatgtcagctcagtcacttactagttgtgtgactttagaaaagtcatttgatctatctgtgcctcagttttcatgtctttcaaacagaatacctgccttacaggattgctgtgaggattaaatgagataacacctataaagctgtacctttataggtgttacatagtaggtaccctatatctagtaactatttttgtatttgtaggttcagttggttatatcttttgtgtggcaagcccatctcactaatgctcttacattgtattgctctgtatccttactcagaaatacttgtttgcttaacagttatgtaccaagccctctgttagacatgggtttggtgagtaaaaacaagtatgatccctatcctcatggaatttatgctctgctaagacagctagttagacataacagaattgcatatacgaatataaaattgcaaccgtaataagaactacaaaagaaagatataggctataatacgggaaatttgacctagtaaaggaaagtcaaggaaagcttcactgagaaagtgatgattaagcagagatctgaaggatgagtaggtgttaactaggtgaaaagaggaaatgattccatgcggaaaggatcgcatacgcaaaagccctgtatgaggaaaggagcgtgaagggattgaaagtaggccagtttggctgaagtgaagagagcaaagaggagttagtgcacaatggatctaaggtagatggagtcttaaaagtggtaatgataaggaacttcatctgtattttttgttagtttgtttgtttttattttttttgagacggagtttcactcttgttgcccaggctggagtgcaatggcgcgatctctgctcactgcagcctatgcctcccaggttcaacaattctgctgcctcagcctcctgagtagccgagattacaggcgctcgcgaccatacctggctaatttttgagtttttagtagagacagggtttcaccatgttggccaggctggtcttgaactcctgacctcagctgatccacccgccttggcctcccaaagtgctgggattacaggcgtgagccaccgcgcccagccgtctgtatttgaagaaagataaatagccatttaagccctagggttgacatgatcagacttgttttttgaaaaaatgactctgactcaagcaagagaaaaggattatttattggaggtaagggtagatgttggcagaccagttaagagttagtcatggtaactcttaactggtctggaaaatgggagaagttgagttgaacagaagtgaacagattccaaaaaatgcttaagagattaaatggacaagatttggtgatggaatggatgtatggtgaaggggaggtattaaggctaggtttctggctcccataactggatgctattctagtgtaccaatcaccgagatgcggaatgtgagcagacagtgtgctttggtaggggaagatcacacatttgatttctaggcatttgtttctgagatgcctttgaaatatccaggagaaaatgtataacctctccaatttgtctttttttaaaaatcaggttatctataaactaataatgttcattatataatttaatcagtgcagaaaagtacaaaatttaaaatatcaccttcaaatcccaccacccagaaataattttcattaactttagataaacatcatgtcaaatatctttctatgtatgtatgcatggaaataactataaaaatgtaaggcagggcagttatgaagatggcattaattaaggtacataattatggttagcacacagaaaggtgctccaaaaatggtagtccctaatagtaacaataggaatagtatgccaaaaagactaggaaggaatattcatttgtgcagcagcaatagaaaaaaaaagaataggaaggaatatagactgataaaagtctataccaaataaactgatcttttgtttttatttttgtttttcttagaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactg

SEQ ID NO: 3421 - DNA, 165182 bp, human
ctcagctccgggccgagcgcgagcttgggctcgtaccccgctcccctctctccgcccgctctttacctaccggccgtagctggcccggtgggctcgcggggagacgctcgcgcgcgcaagcgcacacgacgcggagcggagctcgagacatcgaggagaggagtaagaagcatcggaggaggcgatcgaggaggaggcggtgtgtgtgtatgtgtctattctacggtgtggctcgtcgtggggcgagaggaggctcgagagagggcgagggagaagcgaaaagagtaagagagtcttcctttgcgagagcctctaatctggtgagggtcccgggccggccggggcgctaggagagagggaggaggccggggggcgtgtctgggatcgggctgagagatgaatgggccagggatgaatggagggaggcagcggcggccaagagtctgttaggagtaagcgccctagcggggggcggcttgaccgaagcagggtgagtgccttcaccagtcggtaccggacgaggccgggctccgggctaaggggctgtcgaaactgctgaataggcggagaggaaaatgaacagggggaaagtggggaagggcaggtttgaggctgaggtgcgttttttgttttgttttcttttttgtttttgattttttttttggttgttgttgaggggtgacaactttgggagctgatggaagaccaggggacggggaaggtgaggaggatacaggagggggacaggagacggttgacaaaggactgagtgatcacttaagtgagattgaagctactgaaagggaagatcgcttcgggtgtgggaagttcagttgtattgatgggaataggatgaaggaaagagtagatttatttcagaggttcagctgatgtgtgagggacaggatggggtgagaaatattgctggcttgtgtaaatgtgttaggctcaaggagattctgaggtgttatttgggaaggggtggtgtgtgttgtgtgactgacaggttggggatggggaggagatggtatgataggtgaggatgaaagtggtgaggtggcttcactgtactgaaagaggttttgtttgactagttaaaagtggtgaaacatttatataatggggtgggggtggaaatcctgcacgtgagtatctccgtatcttgggggttgagagactgttaaaatgagactgaaccctcaaaacagatgcgaatagtatggctattttttcttaagagttactgttgattgagacaattatatgaataaaacagcttttgagttgtgaaaatcttctgcatagtagtgattgtatccaatttttggagataccgttatctgtttttcatctatagtaagttgtaataccaagagaacttttgaagaggtcttagtatgtgacagagcagcgggtgtcttttaagacggtctctatcctttggattgatgagtttaaaaattgtttaaactcgacagctcaagggaaagataccttgcattaaaggatagcaaaaatgcactaaagcttagccgggcgtggtggagcgtgcctgtaatcccagctacttgggaggctgaggcagaagaatctcttgaacctgggaggcagaggttgcagctagccaagattgtgccactgcactctagcctgggcgacagagcgagactctgtcttaaaaaatccactaaagctgactttgaactaaaataattgtacattttttttggtcattacgaatttatctttgaaaattggcactcgctttttggtgtgagtttaaattacaacagattacgtgaacattttgttctctgaatacttatcttctgataaggatgtcttgtcctggtctcattctgttctgggtcaagattaacggttatggattttaatcttttgtgattattttttacacattttactgatatatatttagttttcttggaaatgttgcaaacttgagaacattcccatgctgtttttcttttattctgctttgatattggaaagagtgtaatccttgtttaggctacccgcagtttgaatacaaaaggtcatattctgttcatagtctctcagattgagatgaatacttaatgtattaaatagtacagtagaagtataaaggcactgtaagagcctggaaatgttgcactaactcaaccaggcaaggcggcctcccagttttgaactagatgtttctagatgaaggacattcacattttgggtcttgaaagtgtaagcatggtatatttggagaatggaatgagataaggctggaatcttaggttgaggctggggtgaattaggaactcttgattgtttaagaaggggaataacataaacagatttatggtgtttctctctctgcctttgcttctgatgtccccctctacctggaatgctctctctccccctcccctagaatttgaactcattcttttaaaacttaacatttgtcaccagctattcctgaaagcctttcctggtttccctttcttccttttcccagcatcctccaccaagctaggttaggtccccctctttagagttctatcataccttgtacataattttattacggtactttggttgggaggcaggtaggaaaggtatttttctccttctatctgaaaaagaaatgaagcccagaaaaacaagacatgccctagtaagtggtgaaccccggagttctgacttctagaccattgttgatcttcatatcacaagtttacatttgcttaaataattatagttttaggagttagatttctgtagtgttgacttaactttcttccatagagttttgtttttactatattgttcattgctgagccggtaaatgataaagccagtggctgcaaagaaccagagtaggcagaagtaaagaaaataatggatattattattattattttttagagggagtctcgctctgtcacccaggctggagtgcagtggcgtgatcttggcttactgcaacctccgcctcccaggttcaagcaattctcctgcctcagcctccctagtagctgggattacaggcacgtggcaccatgcctggcttatttttgtatttttagtagagatggggttgccccatgttggccaggctggtctcaaactcctgacctcaagtgatccgcccgcctcggcctcccaaagtgctgggattacaggcatgggcccgctatcagatttctagtcagataattgaaataaaaataattaacagagggcctaattttttttatttttaaataatacttattagcatatttaactgatttttaaaaaaataattattttattattttttaagttccggggtacatgtgcaggatgtgcaggtttgtcacacagataaacgcgtgccatggtggtttgctgcacctatcaacccatcacccagctattaagcccagcatgagttggctcttttccctagtactctcccctccttccgcctccctgacaggccacagttaactgttgttcctggagggcttaaattttttgtgtatgttttcgtggggaaggaattgtgtataaggaaaaaaacccctcctttctcagtctctcaatataagtagaccagctctatttacagatatactcgattttgtctcttggccaaaagccagaattctttcaaacgagtgggtcttttccacctttgtttgagatcataacatttatgatgccgttaggagatatttgatgactgaaagacatctataagacattcattcagaaattttaaagctttaaaagtagaattgatacaatttttaattgttttgatagagcttgttatgagatttggtttggcaaatgttgagattgactcactacagaaatgagctttgatgccctttcagggatatatttttctcgtgaatcttttttttttttttgagacagagttttgctctgtcacccaggctggagtgcagtggtgcgatctcagctcactgcaacctctgcctcccaggttcaagctattctcctgcctcactcagcctcccgaggaactgggattataggtgcatgccaccacgcctggctaatttttgtatttttggtatagatggggtttcaccatattggccaggctggtctcgaactcttgaccttgtgatccaccttcctcggcctcccaaagtgctgggattacaggtgtgagccactgtgcctggctgaaagaaatgaagtacattgttttctgtgttttagcatggtaactttttttttttgagagggagtctccctctgtcacccaggctggagtgcaatggtgcgatctcagctcactgcaacctctgcctcctgagttcaaatgattctcctgccttagcctcccgagtagctggaataacaggtgcccgccactacgcccggctaatttttgtatttttagaagagacggggtttcacaatgttagccaggctggtagcatagtaacttttaaaaattgtgataaaattcatgtaatacaaacttaccattttaaccattttattttattttattttatttatttggagatggagtctctctctgtcacccaggctggagtgcaatggcacgatcttggctcactgtaacctctgcctcctgtgttcaagtgattctcctgcctcagcatcccgaatagctgggattacaggcatgcaccaccatgcctggctaatttttgtattttagtagagacagggtttctccatgttggtcaggctggtctccaactcctgacctcaggtgatccgcctgtcttgacttcccaaagagctgggattacaagtatgagccactgcgcctggccccattttaaccattttaaagtgtacagttgtacagtggcattaggtaacttcacaatgttgtgcagctaacaccacctcaaaaggaaattctgttcccagtaagcagtcactccccattgtcccttcctccaagtcccaggtgaccattaatgtttgtctattctgcatatttcacataaatggaatcatataatatatgaccttttgtgtctggctttcactcagcatgtttttgagattcatctgtgttatggcatgtaacattactttattcctttttatggctgagtattattcctttgtatggatataccgtattttgtttatccatttatcagttcatagatatttgggatgtttccaccttttggcttttgtgaatagtgctgctatgaatatttgtatacaagtttttgtttgaatacctgttttcatttattttgggtatacctaggagcgcaactgctaggtcatatataatcctatgttatgttttgttttgagacagggctctgttgcccaggctggagtacagtggcatgatcatggcttagtgcagtttcaaccacccaggctgaggcaatcttcccacctcagcctcctgagtagctgggactataggtgtgtgtcaccacgccccacaccaggctaattttttacatttggtagagacaaggtctccctgtgttgcctgggctggtcataaactcctgagctcaagtgatcctcctgccttagcctctcaaagtatgggggttacaggcatgaaccactgtgcctggccctatgtttaacttgttgagaaaccaccaaaccgttttccatagcagttgcaccaattttcattgccatcagccatgtatgagggttccatttctccacatcctcaccaacacttgttgctttctgttttttacttgttttttaaaaaattatttttatttatttttctttctaaatagccatcataatggtatgaactggtatctcattgtggttttgaattgtatttccctaatgatgttgggcatcttctcatggcgtgttgactatttgtatttcttctttggagagatgtctatttaagttctttgctcattaaaaaatttggttgtttgtctttttattgttgagttttaagagttttttaaaaaatatacagtctagatactagaccctaatcagatatgtgatttgcaaagtttcttccattccatgaattgtctttctgctttattttattgttttgttttgttttgtttttgagatgcagtctcactctgtcacccaggctggagtgcagtggtgagatctcggctcactgcaacatccacctcccaggttcaagcaattcttgtgcctcagcctcccgagttgctgggactacaggtgcgtgccaccacgcccaactagtttttgtatttttggtagaggtggggttttgccatgttagccaggctggtctcgaactcctgacctcagatgatccacccgccttggcctcccaaaggtctagaattacagacgtgagccactgcacccagccagtattttattttattgtaaaaatagagataaggtcttgctatgttgcccaagctggtctcaaactcctgagcttaagtgatcctcccgcctcagcctcccaaagtgttgggattacaggtatgagccaccgcacctggcctttttaactgactcttttgtacagattgttaatgggcaactcttctttaaaggattaaagtaatatagcattagattaaaacgccttttaacccaacttcctgtcctcccatagataaccatttgttaagagttggttccatggttgccaaaataaggatgaaagaaaaaaaaaaaagagttggttgtggaatagttatagtccttttttctctgtatttgcatgcatatgtttgtacatatacaaataacaagtatgtgatatatattttatgacttttctcccgaagagtgtcacttagggctcttttcatatcagtatttatatgttcacttcattctttttgattgatacatagtatttcttcctgtgtgcttctctagctttgactactagggtcagtttagagtatgtctttctagccttttttatatgcattcacccatatatgagtacatttagaaatacatagttttgtgggtttttttttaacacaaatagtatgtagatgtaatatacatgttgtactacaacttacttttctcaccttatagtatatatatgtaggagatttttatatatcagtatatatccatcttgcattttttaaacagatgcttattatttcacagtatggacgtaccatgtttatttcagcattctcctatagatggatatttaagttcttttcaggttgattttgtttgtttgtttgttttgctatttaaaacaatgtttcagtttaaaaaagccctgtacctacatatttgttcacatgcaggaatatttctcaagtgatactactaaggattggaattgctgggtgacagttatgcactagatacttggaatttgccctatgaaaaggctattccagtttagctgccaacaatgcatggaataccaaatttcttatacaattctcaaacttaacagatatttattttttgcatcctgatagatgaaaaatggtactgaatcatttgagtttgtacccctctgtttactaatgagtttgagtaatccccttaccatacatgtattggccacttgtacttacttttcttttttttttttttgagacagagtctcattctgtcacccaggctggagtgcagtggcacagtctcggctcactgcaagctccacctcgtgggttcacgccgttctcctgcctcagcctcccgagtagctgggactataggtgcccgccaccacgcctggctaacttttttgtatttttagtagagacggggtttcaccatgttagccaggatggtcttgatctcctgacctcgtgatcagcctgcctcagcctcccaaagtgctgggattacaggcgtgagccaccgcacctggcctatgtttagcttttaagtccacatggaatttatttttgtgactggtttttggtagggctttagcttaccactcctcaaaattgataaccagttatcccaacacaacttattatactacctgttcttcacaaatttgaaatgccatttttaccatagactgcattcctatacatacatgtgtttgtttctgtactagttctatttcattagttcatttgtctattttaaattaaattttttattttttaaaggtgggatcttgttctcttgactaggctggagtgcagtggcatggtcatagttcactgcagccttcaactcctaaggctcacaagattctcctggcctagtgtcccatgccaccatgccagctaagctaatttgtctgtttctgtgctaaaaccacattgtttaacttactataactatatgttactatctggtaaggcaagttcttgttgttctttatcaagattttcttggctttccttctactctttagaggatcagcttgtcagtttcagacaaaaacatctctttgggattttgattgaaattgcattgattttggaataatagtggggggaggggaattgtgaagatgttgatattgggtctttccatcaaggaacatggtgtagtttgtgtatttcagtaaaatttcatggttttctttatgtaggtgttgtatatttcttcttgagtttgttcctagactagtattttatagctttgttgctcttatgaacaggataattgtttttgtttgtttgtttgtttgtttgtttttgagatggagtcttgctctgtcacccaggctggagtgcagtggcacgatctcggctcactgcaacctccgcctccctggttcaagcaattttcctgcctcagtctcctgagtagctgggactgcaggcgtgcgccaccatgcctggctaatttttttgtatttttagtggagacggggttttgccatgttggccaggctggccttgagctcctgacctcaggtgatccacctgtctgggcctcccaacgtgctgggattacaggcatgagccactgtgcctggtcgatagttgttttttcaaattacattttgtaatgattactgagatatatggcagatttctgtatgttgattttgtctttggcctgtttgctgaactcttgttagttccttgttagttatagttttttagttgattttcttggattttctagatagataatcatgtagtctgcaagttttgagttttgtctcctactttctaacatgtgtaggtcttgttttatttcctcagttggtagtaggaaatcttggcttattcctgactttaacgattgtttatgtgaaagatacttgccctcatgtgtaggataaatgctaattgaaaccacactgagattccttgcttaaacttatcagagtgttaaaaatcaaaatgtttgataacactctttgttgtcaagactctggggtaaaagacactcatacgttggaggtaggagtttaaattggtacattgcccatggaaggcaatttggcagcattatataaagatacacatgtattacatacattattttggatatattagtatacttaaataaataaaagtttaaaaaataaatatgcaaatttcctttgatcttggcagggcacagtggctcacacctgtaatcccagcactttggggaggccgaggccagcggatcacctgagcccaggagaccagcctggccaacatggtgaaacctcgtctctactgaaaatacaaaaattagccaggcatggtggcgtgcgcctgtaatcccagctactctggaggctgaggcaggagaattgcttgaacccgggaggtggaggttgcagtaagctgagatcacgccactgcactccagcctggatgacagagcgagactgtcttaaaaaaaaaatttcctttgatctagcaattctagttcagggatacacacacacacacacacacacacacacatatatacaatgaaatctacaatgttatttataatagcaaacaattgcatactacaaaataagaatgagaaacttatatgtactgaaaaggaaaaacatgtatcttaagttactatgactataaaaagagcttggtgtgtactgtgttcctttttgtgtagatagtgaaggagagaacatatatttgttaatttgcctaaagagattctggaggaatacacaagaatctgttgagtggttacctgttgatggggcaaatggaattgaatggaagggagatagagttgggaatgagcctgccctttataaacctctttacttgatatttgagccacatgattgtattatgtatatgtatatgtacatgtgtatatatataatatagtacatacattgtgttttatatatatatatgtgtatatatatatgtgtatatatatatatgtgtatatatatatatgtcttttattttttttgagacggggtctcactcggtcacccaggctggagtgtagtggcacaatcactgctaactgcagcctcaacctcccaggctcaagcaatcctcctacttcagcctcccaagtagctgggactacaggcgcatactacatgcctggctatttattttttattttttgagatggagtctcgctctgttgcccaggctggagtgcagtggcgctatcttggctcactgtaacctctgcctccggggttcaagtgattctcctgcctcagcctcctgagtagctgggatcataggcacatgccaccacgcccagctaatttttgtatttttagtagagacgaggtttcgctgtgttggtcaggctggtgtcgaactcttgacctcaggtgatccacccaccttggcctcccaaagtggtgggattataggcgtgagccactgtgcccagccacggttgtctttatatatattcctagggcttagataagtgtatttatcattttatgaaggaaaaatggctacatgtaggtaattatatataactgtgaacttagtaagagactccaggtttgaggcctgatttttgtaaactttttcactgggccatgtttctacattgctgaatgtagaagagatattatcctggtcactggagcatatccctttggcaatgccaacatggttcattactgaaaaactttagaaaatatatggttttctgccttcctaaatagaatctcctgaaaatcatttaatgttttctggagtattgttgaatagtactttaatatagtgctgtccctaggggtttttgagacatagaaaataaaagcttgcatttattgattattatattgtgcctggcactgtgctaaatattttatatgtgtattttcatattggtcctgtgagacttcacaaatgcaatgaagaatgattgaggttaactaatttgcccgaaatctcttccaaggattgaaaggcagaactttgattccagatttctcccactccagggcatgtgttctttttttttttttttttttttgagacagagtctcactctgtgatccaggctggagtacagtggtgtgatcacagctcactgcagcctcaacctccctgggctcaggtgatcgtccccacctcagcttctcaagtagcggggactacaggcgcacaataccacacccagctaattttttattttttgtagagacagggttttgccatgttgtccaggctggtcttgaactcctgagctcaagcaatctgccagcctcagtctccccaggtgctgggattattacaggcgtgagccaccactcccggccgaccgagcctgtgttcttttttttttttttttttttttttggctgatcagctaattttgaattccaaaataataagttcacaaaagctattattaatgaaaatattcaacacccaaggtgatttacaaagtttaactgagatactatcttgttcccagaacatttataaacacaacatatatatatatatacacacacatatgtgtgtgtgtatatatatatatcattgagttaaatttatatattgaaaataggaatataagatataaaaataaaaaacacaaaggtttaagtgaaagtttttgtaattatatatttatattgggattgcaagatgaatataatgctatttattttattcttttctttctgaatttatagggcttggaagtattttacacagaaaacgatctgtgttctgacatttccctaaagttctttgaacctcaagatagagatgatctctatttttatactgccatgtaaataggtttggtgctcacccttcgttgttttctttttttttttttttttgatactgagtctcactctgtcgcccaggctggagtgcagtggcgcgatcttggctcattgcaacctctgcctcctggcctcaagcgattctcgtgcctcagcctcccgagtagctgggactacaggcatgtgccaccatgtccggctaattttgtttttgtatttttagtagagatggggtttctattcatatgaaggtagttcaactcctaaggatctgggataggaaataagagaagaaaaatgctgtttctagaatcgcctctttgtggttctaatttcttctcatcagtacctataattgccaaaataatatttttaaaactctgggaaatatgaattcactttggtaatagttcattccgagtatgttttaataactctagataaatatatttaaatgcccttatattttaacatccaccaaattaaatggattttgaagaatccactcaaatacatacatacatacatacatacatacatacatacatacatacatatatatatagttgttgttgttgttgttgttgttgttgttgttgagacagagtctccctttgttccccaggctggagtgcagtggcacaatctcggctcactgcaagctccgcctcccgggttcacaccattctcctgcctcagcctcccgagtagctgggactacaggcgccggccacagctaattttttgtatttttagtagagacggggtttcaccgtgttagccaggatgatctggacctcctgacctcgtgatccgcccgcctcggcctcccagagtgctgggattacaggcgggagccaccgcgcccggcctcaaaattttttttttttttttttgagagggagtctcgctctgtcgcccaggctggaatgcagtggcacgatctccgctcactgcaagctccacctcccgggttcacgccattctcccacctcagcctcacgagtagctgggactacagacgctcgccaccacgcccggctaaaattttgtatttttagtagagacggggtttgaccgtgttagccaggatggtcttgatctcctgacctcgtgttccacccatctcggcctcccaaagtgctgggattacaggcgtgagccaccgcgcccaggcgcccggcctcaaatatttttatgtttagtcaggtcttatattagtttatgagaaccaagactcagttttgtactacaaggcagtgagttattcatatgtttgtgatcattgattgtggtcagaaccacaaagctgaaagactgcaaaaggaacatgtgaaccttctatgctcaatatactgactttggagtggaatttgctttttcttttttttttttcttttgagacggagtctcgctctgtcacccaggctggagtgcagtggcgcgatctgggctcactgcaagctccgcctcccaggttcacgccattctgcctcagcctccggagtagctgggactacaggcgcccgccacgacgcccggctaattttttgtatttttagtagagacggggtttcatcgtgttagccaggatggtctcgatctcctgacctcgtgatccgcctgcctcggcctcccaaagtgctggaattacaggcgtaagccactgcgcccagccagaatttgcttttaattaatgttatttccttagtttttcatggaaaatgtgaattttcccacctttgccagagaaaatacttatatttttatattgaagcccaaagttttttttattaagttgcaaggctaaattaaattattctaatttacaaagttgctagataaatagaatggaattatctttaaaagtggattttggggacaggcatggtggcccatgactgtcatcccagcactttgggaggccaaggagggagaatctcttgagcccaggagtttgagaggagccggggcaatgtggcttgacctcatctctacaaaaaaaattaaaaattaggagtttggtggcacgtgcctgtagtcccagctactcaaaaggctgaagtcggaggatcgcttaagcctgggaggtcaaggctgcagtgaaccgtgatcacaccactgcaattaagcctgggcgacagagtgagaccctgtctcaaaaaaaaaaagtggatattgggatttaaaaatatggaacgcttcacgaatttgcatgtcatccttgtgcaggggccgtgctaatcttctctgtatcattccaattttagtatatatgctgccaaaacaagcacgagcctgtgttttttgtttgtttgtttgtttttgttttttgagatggagtcttgctctgttgctcaggctggagtgcagtggtgcgatcttggctctctgcaacctccacctcccgggttcaagcaattctctgcctcagcctcccgagtagttgggattacaggcgcctgccaccatgctcggctaatttttgtatttttagtaaagacggggtttcatcagcttggccaggctgatcttgaactcctgacctcgtgatccaccctcctcggcctcccaaagtgctaggattacaggcatgagccaccgcgcccggctgagcctgtgttcttaaactgttttatggtgaagatccacgatggccccacatataccatagtcaagaaactattgaggcctggcatggtgactcatgcctataatcccagcactttgggagggtgatgaaggcagattgcttgagcccaggagtttgagactagccagtgcaacatggcaaaaccctgtctctacaaaaaaatacaaaaagttagctaggtgtggaggctcacgcctgtagtcccagctactcgggatgctgaggtgggaggaccacttgatcccagggaggtcaaggctgcaggaagccatgattgctccactgcactccatcctgggtaacagagtgaggccctatctcaaaaaaaagaaaaaaaggaagctatttgaatccacgatggccccagatacgttatacttagtgaagttcttggcctagtttttcttattcgttgtttacctttaggtcaccagctattacattttattgttgtcaggcctttactttctcctgggattcttaacccaggaggccaggctaaagatgagagtggacacaatgaggggtgggagggtaagtatagtttttaaaaggcatatttgataatgtgatggttttgattttcatcaaaatgttttgctttcagatttttttttttttgagacagatttcactcttgtcacccaggctggagtgcaatggcactatcttggctcaccgcaacctctgcctcctgggttcaagtgattctcctgcctcagcctcccaagtagctggaattacaggtgcccgccaccacgcccagctaatttttgtatttttagtaaagacagggtttcaccatgttggctaggctggtctggaactcctgaccacaggtgattgcccaccttggcctcccagagttctgggattacaggcatgtaccaccacgcccagccatatttaaaaaaaattttttttataggcagaatctctctctgtcacccaggctggagtgcaatgttgcaatcatggctcactctagcctcctgggatcaagtgatcctcccacctctgcctccttagtagctgggactataggcgtggaccaccgtgcccagcttattttttttaattttgttttttgtagagacagggtctccctgtgttgcccaggctggtctcaaactcttgggctcaagctatccttctgcctcagcaactcccgccccaaatactgggagtacaggtgttagccactggccctggccaggacatcatattttattgagatacaatttatataacatagactttacaaatataatataaaagtcaatgattttcagtaaatttatagagttgtaaaatcttgattacaactcaattttagttcattaccatcatccctgaaagattgcttgtgcttatttgcagtcaatcctgttcctatgccccagccccaaccactaatctattttctgtttctgtagttttgtattttctggacatttcatataaatgaaatcatatagtatgcagtcttttcctctgacgtctttcgcttagcataatgtcttcatggttcatccttgttgtagcatatatcaatactccattcctttttttttattattttttatttttagagatgggacctcgctatattgcccagggtagcaggcagtggctattcatgggcatgatcatagcacactgcagccttgaacttctgggctcaagtgatcctcccacctcagcctcctgggtaactgagattataggtgtgtgccaccacacctgacaccattcgtttttattgcccagtaatattcttttttttttttgagatggagcttcactctttcgcccaggttggagtgaagtggcgccatcttggctcgctgcaacctctgccccctgggttcaagcgattttcctgcctcagcctcctgagtagctgggattctaggtacccactaccacgcctggctaatttttgtatttttagtagagatggggtttcaccatgttggccaggctggtctcgaactcctgacctcaaatgattcacctacctcggcttcccaaagtgctaggattacaggtgtgagccactgtgcccagccttcccattaatattctattacacctaatacattttgtttatccattcatcagttgatagacatttggattgtttccacctttgggtattgtgaatagtgctgctatgaacacttgtacaagtttttgtgtggacatatgttttcatttctcttaggtagatgatatcatatggtaactctgtttaacttactgaggaactgccagactgtgttccaaagcagctgtaccattttacattcccactagcagtgtatgagggttctgttttcttcatgtgcttgtcaacacttgttactgtctttttttattgtagggtatgaagtggcatttcattgtggttttgatttgcatttccacaataagtaatgatgtggaacaactttttatgtgtttattggtcttttggatttcttctttatagaaatgtctattcagatcttttgcctattttaaaattggattatttgtcttgtcattattgggttcttttttttttttatttttactcagggtcccactctgtcaccaaggctggagtgcagtggtgcgatctcagcttactgcaatctccacctcccaggctcaagcgattctcctgcctcagccttctgagtagctaggattacaggcgtgcgccactactgcccggctaatttttgtatttttagtagagatggggtttcaccatgttggccaggctggtcttgaactcctgatctcaaatgatccacccgcctcagcctcccagagtgctgggattacaggtgtgagccaatgcacccggccattattgagttcttgatatagtttgataccatcccctatcacatatatgatttggcacatactttctcctcccctgtaggttgtcttcacctctttcttgaaggtatcctttgaagcacaaaagtttaaaattttgatgaggtgaagcttctctgtttttttggttttttgtttttttgagactgagtcttattctgttacccaggctggagtgcagaggcgtgatctcggctcactgtaacctctgcttcccaggttcaagcgattcttgtgcctcagcctcctgagtagctgggattacgggcacatgccaccatgcctggctaatttttgtatttttagtagagatgggttttcaccatgttggctaggctggtctcaaactcctgacctcaagtgatccacctgccttggactcccaaacagaggcgtgagccaccgcgcccagccgaggtgcagcttcttaattttctcttttatgcttgtggttttagtgttgtggctgggaattgtctgacccgagttactgagatttactccaatgttttcttctaaaagttttatagttttagcttttgtatttaggactgtgatccactttaaatttctgtgtatggtacgaggtcggggtccagcttcattcttttgcatgtggattgcagttatgccacaagtttggttgaaataactgttcttttcctattgaatggtcttaacctctgtattgaaaatcaattgaccataaatgttacggcttttagactctcagttctattgacctatatgtctgtccttaccctgttgttcatttctaatttattcatttttggtaggagagcatgctttgtatgatttcaatctctttaaatttgttgagatttgttttattgcatagcatatgatttttttttcagagaatgttctatgtgtgcttgaaaagaatgtctattttgctattgttgggtgaagtgttctgtagatgtcacttaggtcaagttggttgatagtattgaccaagttttccatatacttgttgattttctgtctagttactctctccattattgagagtggggtattgaaatcttttgctattactgaattatctatttctccagttttgtcagtttttattaaatgtattttgggactctgttgttagatgcgtttatggtatattgtcttgatgaattaacttttatccacgtaaaatgcccctccttttctctagtaacatatttttgtcttagggtactggtttttaaaagactgagggaagatttctttcttcatccttcttatttgcttctttttttttttttttttgagacagagtcttgctctgtcacccaggctggagtgcagtggcatggtcttggctcactgcagcctctgcctcccagattcaagctattctcatgcctcagcctcccgagcagctgggattataggcacgtaccaccacacccggctaatttttgtatttttaatataaatggggtttcaccatgttggccagtgtggtctcaaactcctgacctcaggtgatccacccacctcagcctcccaaagtgctgggtttacaagtgtgagccaccacgcccaggtcttatttgcttcttatcctatactttgggaagccaggtgttagaattattataccagagcaccagtacttgccactcctctattatattaggggtctgaataagattttattttgttttttattttaattaattaattttttttgagacagagtctcactctgtcacccaggttggactgtagtggcttactgcagcctcaacttcccaggctcaggtgatcctcccacctcagcctccccggtagctaagactacaggtgcatgccaccatgcctggctaagtattttttttttttttaaacaggttcttgctctgtcgcccaggctggaatgtggtgacgtgatcttggctcactgcaacctctgcattctgggttcaagcgattcttgagcttcagcctcccaagtagctgggattacaagcatacacaaccacacctggctaatttttgtatttttcagtagagacggggtttcaccatgttggccaggctggtctagaacttctgacctcaggtaaccggcctgccctggcctcccaaaatgctgggattataggtgtgagccaccgtgcccagcccagcctattgtttttaaattaaaaaaaaattttcccaacaccatggacctgaaggcaaagttttttttgttttgttttgagacaaggtctctgtcacccaggctagagtgcagtggctctgtcaatcttactacaaccttgtcctcctgggctcaagggatcctcctgcctcagcctcctggagtttgggctacaggcacatgccaacatacccagctaattttgtaatttttttgtagagatggggtcttgccatgttgcccaggctggtctcaaactcctgggctcaagcaatcctccctccttggcctcccaaattcctgggattataagcatgagctactgtgtctggccaaagattttattttattttatttatttttgagacagggtctcactcagtcacccagtcctgagtgcagtggtgtgatctcggctcacgacaacctctgcctcctgggttcaagctattcttgtgcctcagcctcctgagtacctgggattgcaggcgtaatccattgcacctggcctcaaatattttatttatttatttatttatttatttatttatttatttatttgagactagtctcgctctgtcgcccaggctagcgtgcagtggcgcaatctcggctctctgcaacctctgcctcccgggttcaagcaattctctgcctcagcctctgagtagctgagattacaggcacccgccaccacactcagctaatttttgtatttttagtagagatgaggtttcaccatcttggccaggctggtcttggaactcctgacctcatgatccacccaccttggcctcccaaagtgctgggattacaggcgtgagccaccgcacccagccaaagattttattttttttaaataggttctgtagtaaaaaaaattttgaaggctttccaacttaaattctctggcttaactatttttggctccttgcttagatgcccttttgtctaacttgtggagttttgctcttgaggtttaaaatctcacctaaaatgtttaacatttggggaacgtcggtgaatactggattctttttatgctcttgcaggtttttttttcccaagtcaaaaattatttcagaataaagagttaaactagttaactttttttcacttgcatacaatactagtcttattaagtgactttggaagtgatttggcaatgtaacctcatagagaccttcatgagttcagttcttagctttggtattaacatagatatgtcctagtaatgtcatctggttggcaaatttttgtgagtcaccgtaagactctttcttttccctcacagccatattcattcagacagtaaattttcttgcatttagtagttccctaatgtgttttgaacctatccctcctgccactattttcattcaaacctcatcatctcttctggattgttgcagtagctttttaatgggtctccttgttttacattgtatggcatagaagtccctggtgtctatctgcctctctgtcctcatctgtctgcttcttctgatacacatgtaaacaactgctcatgataccactcatacacttactccatactgtttaatgcctttgcttgtgatcttccctctgcctggatcagctaattatctttctttgagactcaactcaggcattttttttcccagaaaaacttactagaggatctgacttcattcttttgcatgtggatatccagttgtcccagcaccatttgttggaaaaaatattctttcccccactgaattttcttggcaaccttgtgggtttttttggggggatggggagggtggggcaggggtgagacagagtctcactctgtcacccaggctggagtgcagtggtgagatctcagctcactgcatcctccacctcccaggttcaagcgattcacagccttcactgcccaggttcaagtgattctcctgcctcagcctcccgagtagctgggactacaggcacctgccaccatgcctggttaattttttgtattttatagagatggggtttcaccatgttgcccaggatggtctcgaactcctgagctcaggcagtccacccaccttggcctcccaaagtgctaagattgcaggcgtgagccactgcacccggctattcttgttgaaaatcaattaaccataaataatatggctttatttctgaactcaatttttattccatttatctatacatctattcttatgccagaaccatactgtcttaatactgtacctttgtagtaggttgttaaggagtatggatcctccaaatttgttctttttcaagattgtattagctttgattattatgggtcccttgacattctatatgcattttaggattagcttgatgttttctgcaaagaaaccagctggaattttgatgaagtgagttgaatgtgtagaacaacttggagtatttgtctctattttgtttgttttattttatttttattttgtttattttagttcaaggttttttttcttcagcttctcaaattgatatttctgtgcatttttggtttgacataattcttaacaaatctttgtgacaaactgcgccctttgaggtgcgtaacatagtaagaagtatacaggcttaactttgcagtgcatgattgtggtgagaagggaagcattttcttattggtggtttgactactcacttgaaaaactttttcccacatattttcacatgtttattgtgcaaagttttagaaaatacaaaaaagcagaaagaaaaatccataatttcagaattatgtctgtaagcttgtatatattcctttttacatttaaccatataatatatagggaacgtcttttatctcactgaagactacagtgttttattgttgttgttgttgttttgttttttgagacagagtctccgtcgcccaggctggagtgcagtggcgcaacctcagcctcccaggttcgagtgattctcctgcctaagcctcccgggtagctgggattacaggtgcccgccaccacaccctgctaaatttttttgtatttttagtagagtcagggtttcactaaaccaggctggtttggtctcgaactcctgacctcaagtgatctgcccgcctcggcctcccaaagtgctgggattacaggtgtgagccaccgtgcccagcctacagtgttatttttaatgttgtggcatacctcattttgagatacttaattaaacaccaattaggcttatgtttagttttttccataagtgctagaatgaacatctttatagttaaatctttgcacagattcttgactattttctaaggcaagttcctataagtagaattgctagtttaaaagaatacgtggttttgagtctttcttgctattgttttaggatagtgtattaatatttgacaatagtttctgttaaaatctgaaggcaagcttataaatatttgcattatttcaaattgctgttggatgtttatagcagcaacattcacaatagtcaaaaggtggaagcaatccaatccattggcagatgaatgggatgaacaaaatgtggtctataacatatggaatattattcagccttaaaaaggaatgaaattctgatacatgctacaacatcagtggaccttgaaaatattatactaagtgaaataggccagacacaaaaggacaaatgtggtctgattccatttatatgaattacctagaataagcaaattcatagagacagaaagtagaagttaccaggggtgggtgggggctgatagggaatcattgtttaactggtacagagtttcaatttgggatgattaaaaagctctgggcatggatagtagtgatgattgcacaacactgtgaatgtacttaacaccactgaattgtataattaaaaatggttaaaatggtaaatttgacgatatgtatattttagtacagtaaaagaaactactattgatgaattccagaattttagacaaaaaccacctagaaaccatgtggttgttttacttactgtgtttgtcacattgtggctaagtgaactcagggtttgggtactcattttgaatttgatggattgacagatggagctgagaactaggtttctaaccaatattcatgcaatatgaagacagattgagctatatactaagtagtctgctagacactgaggactaatggtaaacaagataagacacagtccctagagtctgctggttcctaagattggacagaaaaaagaataaacttcttattaaggaaaaagggattaaaaaatcaggtgatttgttttctccttaatgatttcctttgtagggtgattttaaaatatctttttcccccccttcaggttgctatggaaatacatgaccacgcaaaaggaagtccattctgataattctgatacctgagatgtaactggactgaagagtagaaacaggaaaaattttagtgccaactttaattacaatggccactgattcaggggatccagccagcacagaagattctgagaaacctgatggaatttcatttgaaaacagagttccccaggtcgctgcaactttgacagtagaagctagactaaaggagaaaaacagtaccttctctgcttctggggaaactgtagaaaggaagagatttttccgaaagagtgttgaaatgacggaagatgacaaagttgccgaatcatcccccaaagatgagagaattaaggctgcaatgaatattccaagagtagataagcttccttcaaatgtgttgagaggtggacaagaagttaaatatgaacagtgttcaaagtcaacctcagaaatctcaaaagattgtttcaaggagaaaaatgaaaaggaaatggaagaagaagcagaaatgaaggctgtagctacttctcctagtggcagattcctgaaatttgacatagaactaggaagaggagcatttaaaacagtatataaaggactggacactgaaacatgggttgaggttgcttggtgtgagctgcaggtaggtatataatcttcttggttataataaattcaagttttagctggcctggccttctgtgtgattcatgattatccatgtatcatggattaaaataaaataaagggcttgtcccccacatcctagaaattatggtcctttcctatatcctcttaggagctcactccaaacttttttttctcctgttgttttcttttctgttttaaaggggaagaaaaaaaaatctatcatggctttgtttttctttttcttttttctttttttttttttttgaggcggaatcttgatctgtcacccaggctggagtgcagtggtgcagtctcggctcactgcaacctctgccgcctcagcctcccaaatagctgggattacaggtgcacgccactacgccccgctaattttttggttttttagtagagacagggtttcaccatgttgagcaggctggtcttgaactcctgacctcaggtgatcctcccgccttggcctcccaaagtgttgggattacaggcatgagtcatggctcctggcctatcatgactttcttttggaaaaattgttttaatttgttagctttaggaaagtccccaaactcttaatgtctccttttgaaaacttttcataaatatatgacttatgagttgattgttatactaagtacttgagaatgtgatagggaaatatattcagtgtggcatataccttttctctttttctttcaataaaatcttgggggttcatgtggtgtttttcagaacaggaaaggttttacttgattctttgaggacctttactgatagaagctcatgatgcctttgagtttacctcagagagtatctctggaagaaataatcaccagaatctattgaagttattcagctagaatgtgtttagaaatgagaaatgaaagcaacaggagaatgattgaattgcctacatatttggttccataataaatgttcatgtagtacttttaattaatgaagaactaaatagggacagaacatcatagaaggggttataatgagaagttttagacagatgtgggtcaaatataaggaaaacctctgtgacctcagtcagcccataggaaatggttggttattgatcacatgggatgcttaaaattaggatggaataaagccagttgctaagaacaggtttctgttgctcaaattccagtggtctccgtgagtgtaggtgtatatgtatgaaaacaccatgatttcactcattctgaatttgctgtaggttgctgttcagataggttggaatttagtccaggtttctgcatttctaggaagctttttgtttaatgccatggtttccaaactttactgtttataagagtcagtatttgcttcatatgcaaactctagggcccgttggtacaaattctgattcaataaatctggattggggtgcaagactgcaatttttaaaaactttctaagtgcttctaatttagggagtcccttgaacactctttagaaagcaagttacttatcagtcagacccattccggtgggcctcgaaaggtatgtgcatgtgtggagtttgcttggttttcttctcacctgctttttaccctttaagaattttatatggtatacattgtagtagaaatattagataatgcaggcaagcaagcatcagaatgacctaaaattccagtactttgagtacaaggctttaaacattttagtatatacatctttctggtatatgtatgtgtgtatatatatatatatatatgcacacacacacatatatctttctataaaattttataatctttattttcacttatcttgaatctcttttcattatctgtaagtgtatatttatttatttatttttgttagtgtatatttacataattttttttctttttaaattttattttttgatttccaaattttaagttcagaggtacatgtgcaggatgtgcaggtttgttacataggtaaacgtgtgccatggtggtttgctgcataaatcatcccatcacctaggtatttagcccagcatccattagctgttcttcctgatgctctccctcctcccacccacccccattttttattttttatttattttattaattttttaattttattttttgagacagagtctcactcttttgcccaggctggagtgcagtggcatgatctcggctcattgtaacctccacctcccaggctgaagcaattctcccacttcagcctctcgagtagctgggactacaggtgtgtgccaccactcctggctaattttgtttttgtattttttttttattatactttaagttttaggatacatgtgcacaacgtgcaggtttgtttttgtatttttagtagagatgggttttgccgtgttgccctggttggtctcaaactcctgggctcaagccatctgcctgccttggcctcccacggtgctgggattacaggcgtcagccactgtgcctggcctacataatttttttaaaatagatgcctactatttcattataaggttcttctaggttatttaagcagtcccatattgttggatatgtagggccttttatttttttgggagacataatctcacgccgtcatctaggctggaatgcagtggcgctgtcttggctcactgaagccttaacgtcctgggctcaagtgatcctcccacctcagcctccctagtagctgggactgcggatgtgtgccaccacactcaggtaatagtgttttttgtttgtttgtttgtttgtttgttttagacggagtcttgctctgttgcccagggtagagtgcagtggcacaatctcggctcactgcaacctccacctcccaggttcaagtgattattctgcctcagcctccctagtagctgggactacaggtgtgtgccaccacgcctggctaatttttgtatttttagtagagataggggtttcaccatattggccaggctggtctcgaactcctgaccttgtgatctgcctgcctcggcctcccaaagtgctgggattacaggcgtgagccaccatgcctggccgtgtttttattttttgtggaaatgaagtcttactattttgcccaagctggtctcacacttctaggctcaagtgctccttccacttcggcttcccaaaatgctgggattataggcatgagccactgtagcctgccaaggtttttcctctctactattttactattataaccatggctatgatgaacatccttgtgtataatattgaaagttatgtaaattttaatttcatctctgcattgtgacatcagtagcactcaactttgcatgataccatctgtaaatgagggaaataatttccattcacttggtagtagggtacatagtaaagataagtcagtcattttgcaagctgtgtactctagttatgttaaaggatgtttaggtaaaacttgaaaatatttcagtgggagaaactgcataggatactgactttttttttttttttaagacagagtcttgctctgttgcccaggctggagtgctgtggtgcaatctcggctcactgcaacctcctgggttccagcctcctgggttcaagcgattctcttgcctcagcctcccgagtagctgggattacaggcatgtaccaccatgcccggctaatttttgtatttttagtagaggcaggtttcaacatactggccaggctggtcttgaactccggacctcaggtgatctgcccgccttggcctcccaaagtgctgggagtacaggcgtgagccaccgcacctggctgtaggatactgacttctatcattcacctctggaaaggtttaaaaatctcataaggtcttactactcgaagtgtggtccctggaccagcagcatggacatcacctgggagcttgtcagaactgcatattcccaggcctcattccagacattctgaatcagaatctgacttttggtaacacatccaagtgatttgtatgcacagttaagtagagtttgggaagcacttgaaatatgggaccaaacccaaaagctagctgaaacacagtaggcattcctttaatacactaacatgatctttatattatattatgtattctgatttccggcttccagtccagacttctcaaattggaatctttaggagatgagctccaggaacttactgtttaaaagttcccaagatgctgggcatggtggtgctcacctatagtcctagctactcagaaggttgaggcaggagagtcacttgagccccagagtttgaggctgcagtgagttgtgattgtgccccactgcactccaccctgggtgacagaatgagaccctgtctcaaaaaaaagttccctaggtgattggatacatagccagatttcagaatctctaatgtggaggaaatgtaatatataaagtacattttaatttacacagaaaacaacaattgtaattttctgttctaaaaggaatgtcagaattagtggacttatttaatcagtttttggatattgcttcgtcttctccttttttttttttaaaggcaaagtcttgctctgttgcccaggctagagtacagtggcatgatcatagctcactgtaacctcgaatgcctgggctcaggatcctcccgaatagccaggactacaggcataggccaccatccccagctaatttttttttttttgaaatattttgtagagatgccttagcctcccaaaatgctggaattacaggcatgagccaccgtgcccagcctgcatatttgaaattaagaaaaactagcttatttataatcccaggagaataaggggcatcatctttgaattacttcctgagtacaatgcagtttgtaatgtacaatttctcattcttcttctacagtcttatttattatataattaaacaagtctgtagaagaagaccccagtgagcagtttgaatgtctaaattattctagattctttttcattctttttttatatgtgtgtgcgagattgtatatataatatatatataattgatatgtccatacttttgtcttatcaatttgatatatgttctatttattaccattattaaaatatataaactatagcattgacactacctcttgcttaattttctcccctaatgttaggtaattcttttctttttttttttcttttttattttttgagacagggtctccctctgtcacccaggctggagtgcagtggtaatgatcacagctcactgtagccttgaccttgtgggcttaattgattctcccacctcagcctccctagtagctgggaccacagatgtgtgtcaccatgcctggctaatttttgtattttttgtagagacggggttttgccatgttgcccaggctggcctcaagtgatctgcccgtctcggcctcccaaagtgctgggattacaggcatgagccaccaccacctggccttttgatttttagagacagagtctcactctgtctgccagattggtcttgaagtcctgggctcaagtgatcctcctgccttggccaaccaagtagctgggactacaggcacaagccactgtacctggtacttttcttttttttaaattttatttttgcgtgtttgatttgaaatttatagctcaacaataggttttaatacctttttctcttgatggcattcccttcttccccattgtggatatttgagtcttgtgaaataattctgtttgtttgctttttgtagagacagtctcattatgttgtccaggccagtctcgaactcctggcttctagaggtcctcctgtctctgcctctcagagtgctgagattacagacatgagccaccatgcccagcctaattctgtcttttttatcaccaacaaagcaaaggcaaattgtgtaataattcttaacagccccactccatttgtttagaatacattgaccttatggtgctgcaaagaactgggagcgataaattttactgctgatatttgactttgaggatgttgaaaacaaactctcagatttaggatttggctataaacacctgcatttcaagtttttcatattttatggtttccataacttgatttttttaagagacaaggtcttgctctgttgcccaggctggaatgcaatggcatgttgtagctcactgcaacctcaaactcctatgctccatcagtcttccccgctcagacttcctagtggcatgatctcggctcactgcaacctctgcctcctgggttcaagcaattcttctgtctcagcctcccgagtagctgggactacaggcgcttgccaccacacctagctaattttttgtatttttagtagagacggggtttcactgtgttagccaggatggtctcgatctcctgacctcaagtgatctgcctgcctcagtctcccaaagtacaggattacaggtgtgagccactgcacccggctataatttctttcattttaattttattatttttttttagaggcagggtctcactatgttgcttgggctggtctcaaactcctgggctcaagtgattctcctgccttggcctctcaaagttctggaattacaggcatgagccactgcacccagtctttaatttttgtagagatggggttttgctatgttgctcaggctagtcttgaactcctgggttcaagtgatcctcctaccttggcctccaaaaacactgggattacaggcatgagccactgtacctggctcccataactttatttaaaaaatatattaatggggcctggtgcggtggctcacgcctgtaatcccagcactttggaaggccgaggcaggcggatcacgaggtcaggagattgagaccatcctggctaacacagtgaaatctcgtctctactaaaaatacaaaaaattagccgggtgtagtggcgggcatctgtagtcccagctactcgggaggctgaggcaggagaatggcgtgaacccaggaggcggagcttacagtgagctgagatcacgctactgcactccagcctgggcaacagagcgagacttcatctcaaaaaaaaaaaaaaatcaaacaaacaaacaaaaattaatggaaagactttgacctattgttctttgtaaaaactttggtaaattacttggtgattacttggtaaattagtaaattactgtgagtgagggctataagtcgtaagtgctatttagaagactatattttagtttatgatgttgaaagacttggtcacatgttactgaaagaccagtttagcaactctcagaaagaatcagtcacaggagtttgtaatagtttcttcctccactaacaatttgaaaattaacatcacttagcttttacacatggaaatacaaccagtttttgctctatgatgagttggaaaatacttacaccagtacatttatcatttgttttcttcatataatggaactatttcctttttttttttttttttttttttttttgagagggagtttcgctcttgttgcccaggctggagtgcaatggcatgatcttggctcactgcaacctccgcctcccgggttcaagcgattctcctgtctcagcctcctgagttgctgggattacaggcatgtgctaccatgcccagctaatttttgtgtttttagtagagactgggtttcaccattttggccaggctagtcttgaactcctgacttcaagtgatccacccgtctcggccttccaaagtgctgggattacagtcgtgagccacaacgcccggccaatggaacttttttctaaatatagaaacatcatagagatttgaaatatgttttgttgactttttctgaaatgtatttgagtgtgcttgtaataagcctcactctgtggtcagatatgtgattgtgtactttggagggtaacagacctttgaatagcacttagatatctaacaactcgagctatagcctgttaaccgaaccaaacatgacactgaaaagaaataccaaaaggaaaaaaatggcacaatagagtatagcaggttgacacgttgagtgagcattctaatatactttcattatagtaatgaatatactcaaagcaatgcagtggaagtaacagcttaaaaatccatacttccacacctgaagcatctatcaaaattgtggaagaacttatttctattttattttcattcatcatctaagtatactttggggaaaactatattttgagacattagccctattacatttgattgtgaaattagaattagatacgaaaacagttgaatttccaataaaggaaaaagtaatttaaaaagatgctagaatttctgtttctgaatatagttgtttacagtattcgcactgggacatttaattttgctccccaaatatttttatgtccctcttggaaatgtttctggattctgtttagccgtgtaagaaagtgcttcattacattataggcacacgccaaatagtctgattcagtttgatttcccactctcttcatcagatccagccctaaaagtagaattcagtcatggacaaagcgtgattacattgaagggaggagggatagagcttgcttaaatatacatgttctcatctctgtttaaaaactagtcacgaactttattaaatataaaccaaaggcaaatgcttttacaaaatgacaaagggtgggagtggcaggagatagcctttgtctgggaaatagcattaatttccccagttagttgagtgagttagttttgagctaattatttgcttgatagatttaaaaaattgatacatgtggtaagctgaaaatagccccccaaagatgtccatgtcctaatccctggaacctgtgaatatgtcatcttacatttcaaaaaggactttgcagatgcgattaacttaaagatctagggattggaagattaccctggattatctgggtggacccagtgtaatcacaagggtccttataagagggaggcagaatggccatagtcagaggaggagatctgatgatggaagcagaggctggagtgatgcagttgctgacaatgagccaacgaatgtggacagtctccagaagctggaaaagataaggaaacattcttctctagagtcttcacaggaatgcagccctcctgataccttgattttagtctagagagactcaatttggatttcttaatccctacaactagcagataatacatttctgttttaagccactgtgtttgttgtaatttgttacagtagcaataggaaatgaatacaatagactatagctgccatttgttcattcaacaaataaatagtacctgcaatgtgccagacacatgccaagtgctagggacataatggggagaaaaagcagacacaggcctcattttcacaaagcttacagtagaaggagtttacagttataagaaggcttagaaattggagttcgtgaaatgatgaaagggctgtttaatataggtttgtttaaaggaaatggtagggttgacagtagggggcaacagggataccactcctttattacatagttttcttttttaaaaactttttattttgatatattttctactcacagaagagttgcaaaaagagtatagaaagttcctgtatacccatcacccagactccctttatgttaatatcttgtatttttatttttggtagagatggggtcttgctatgctgaacaggctgatctctaactcctggcctcaagcattcctcctgcctcggcctcccaaagtgctgggattacaggtgtgagccaccatgcttggcccttagttgttttttagattgccccttagttgttttttagattgccccttaatttgactttgtcttatgttttctcatgcttagatttagactatgcatttttggcaggaataccacagaagtgatgcaccatcctcagtgcatcataactgggggtacatggtgttgttttgtattactggtgataataatcttgatcacttggttaaggtggtatctgccaggctttctctcctgtaaagttactgtttttcctgttgtatattagtaaatatcttgggggtagatctttgagactatgcaaatatactgttttcttttaaacttttgcccgctgattttagcatccgttggtgtatcttgcatgtcatcattataactgtagtgttctaatgatttttttctcacattccttctgcatttattaattggcattaacctgttagttttatgtgatttctccccagtatacctgttaagtttctggaaacccaacaataggagaatttatggttgagatactttggtatagttagtaatagcaggtatcatatattttccattatcaaaattaacattaatggaacatttatactggtacttaatttgaatattttatttaatccttagaataggtatatgagataaggattattagttttcagatggtggaactgaaatttagatatgttaagcaattttcccaatggagcagagtcaggatttgtattccatcaattatatctatgtaaagcatttacatagatgattgaagaatttcccactcactagttacttgggcagatcattcttttatgtttttaaccattttagaacaaatgatttcttaaacggatcctgtttaagattcttaacattgaactaccgaaactcaagggatgtcagttaatggtgtcattgaagggcacctgaggaatagtttcgtgattagatggtcatggttcagtatctggccttcaccttttgtcaatgtccagaggttggggagttggggagactgacttgtgttcactccagctcctaaatctaggatacaagtttattattttaaaatgagaaatatagttgttaggtaaaatgttctatatagtctttaggctagttacatggggagctaaattataatcagaagctggcttggtgcttatagagtcggaacaaaggagctagatgttcctgtatgtcctcctgctaaggcaagagcctgaccaaatgaaccgaatgctcacattctgattggatgaggacatctttgatcagcagttctggaagataagtgaacctggttctatgcatggtttattgccttttgatttattaccttgactaccacttgtgagcacttttcttttttctttctttttttttttttttgggatggagtcttgctctgtcactcaggctggagtgcgatggcgtgatctcggctcactgcaacctctgcctccggggtcaagcgaattttctgcctcccgggtcaagcgaatttcctgcctcagcctctcgagtagctgggattataggcatgcgctaccacgcccagctaatttttgtatttttagtagagatggggtttcaccatgttggccaggctggtctcgaactcctgacctcaggtgatccacccgcctcagcctcccaaagtgttgggattacaggtgtgagccaccgcgctcagccaagcacttttctttaggtattaataccattgctgtctcaaagctttagtatggtaatatgaccagattatgactattataccgtgatttcttaattgatatgttgatgtcaccttttacaaattatcgttatcctcagtgtctgtttatttcatttagcatgagttctggggtactacaccatctctccatggaaagtggtttgtgaatgagatatctgcactcattgccatgactgctgtttctgagaggcagagtagtgaaccagaaagtgctttggattcagaattcagcgtacggggttccagtgttgcctgtgccagttaggtaccttgggtaagccagatagtttaactggagccttaattttttacttttcttttaaagaaaaacatgataaatactttggatgtactaaaaagaataaagagtaacataatggaaactgtgtacctactgcccagtttaagaaataaaacattggctgggggcggtagctcacgcctgtaatcccagcactgtgggaggctgaggtgggtggatcacctgaggtcagacattcgagatcagcctggccaacatggcgaaactcctcctctactaaaaataccaaaattagcggcgcatggtggcgcatgcctgtaatcccagctactcagaaggctgaggcaggagaattgcttgaacccgggaggtggaggttgcggtgagcccagatcatgccattgcactccagcctgggtgacagagcaagactccatctcaaaaaaaaaagaaaagaaaacattgaggattagagagattacttttaaagcatgtgacgcattttagtgttcaataaatggtagtgttaaaatactgagcaacctcatgtttatcaagaatattcaagctgaggcaggagaatagcttgaggataggaattcaagaccagcctggtcaacatagcaagggctcatctccacagaaagaaaaaaaaaaaaagctgagcataggcatagtggcatgtcccagtagtgtcttgggtatttgggagactgaggcaagaggatcatgtgagcccaggagttcaaggctgcagtgaactatgatcgtgccactgcactccagcctgggcaacacagagtgagaccctgtctctctaaaaagaaaaaaaatattcattgatagagtgctttataagctaagcatcattttgaagcctttgtaatattcatccttacttgattaggttattttataatatagcttttatatcattgttaatgatttctcctttcacatttgcggaaacagatccatgtagcctctgacttgtttctgtagatcattgttggtgtttgcattaagatatatacctgataaggacatagtttactttttggaaatgaaatgcttcttatcttgaataaatatatatacaggttggtcatactggtattgtgccatgtctcaggaaaggttttgtgtacacttttagcattccatatgttataatagatttaatgtttagttaacatttataaaaggataatatttctttttacagtagtgtggagtagttgaaatctatttgataaatttgtatttgactcctatttatcagctatataaatgaacatttataacactgatatttgacataaaattgatatttgatgctttcttcttggtgtccttaccttgagacagcaagatttagggatcattttcatagaccagaattttcccagcatttgactatgtcagcttcattagctagtgctgttctctggtttgtcttttgtggctcatcattcctttcttgtgtaagaattcttattgatgatgtgtgaaagtttctctaccaaagtggttgtcattaatacaataatgcatgtaggggtgtgtgtgtttaaaggatgttactgtggtagctgaaagctctactctaagtattttcctctggattttggtgctactttaacaggtttactttccccttgctaaatgtgaagtggagttttgaagatcttggctctacatttttagtagacttcacctccagcagtatatctgggaaaacagttgtaattttgtaaagttgtttattcctaatgctgactactttcaatctgtagaatcaaaggatgaagtagggtagtttagtatggcacatgaaagacttggcattctactaatttaatcagaaggcatcaaaatttattcattattctggccaggtatggtgactcatgcctataatcctagcactttgggaggctgaggcaggcagatcacttgagctcaggagtttgagaccagcctgggcaacatggcgaaatcccatctttacaaaaaatacaaaaatcagctgggtgtggtggcatgtgcctgtagtcccagctacttggtaggctgaggtgggaggatcgcttgaacctgggaggtggaagttgcagtgagctgagatcgcgccactgcactccagcctgagtgacagagtgacaccctgtctcaaaaaagaattactaattattcttcagagtagatctgctgtctatcatgagtagaggacttctagccagttataggggcacttaagacttattagtcaggttgggctgggtgcagtggctcatacctgtaatcccagcactttgggaggccgaggtgggcggatcgcctgaggtcaggagttcaaaaccagcctggccaacatggcgaaaccctttctctactaaaaatacaaaaattagtcaggcgtgatggcgggcacctgtaatcccagctactgggggaggctgaggcacgagaatcgcttgatcccgggaagtggaggttgcagtgaaccgaggtcacactactcactccagcctggatgacagagcaagactccatctcaaaaaaaaaagaaaagacttattaggccagatagtaaagcataaagactctacttgtttccttgcttttgttctctgagttccttattttttttcaagacagggtcttgctctcttacctaggctggagtgcagtggcgtgaccatagttcactgcagccttgaacgcctgggctcaagtgatcctcctgcctcagcctcccaagtagctaggactacaggtgcatgcctccatgcccagctattttgtatagttggggtcttgttttgttgcccaagctggtcttgaactccttcctagcctccctaagtactgggattacagatgtgaaccactgtgcctgctgacttccttaactttctaaaaaatattttttattgtggcaaaatgtctaatatataacaagagttaccatcttaaccttttttttttttttgagacagagtctcactctgttgtccaggctggagtgaagtggcatgatatcagctcactgcaacccctgcctcctgggttcaagcaattctcatgcctcagcctcccgagttgctgggatcacaggcgcgtgccaccacagccggataatttttgtatttttagtagagaatggggttttgccatgttggctgggctggtctcgaactcctggcctcaggttatctgcccgtcttgacctcccaaagtgctgggattacaggcgtgagccactgtgcccagccatcttaaccatttttaagtgtgcagtttttcagtggcattaagtatatttacatcattgtacatccctcagcaatatccatctccagtacttttttatcattccaaatagaaactctatactcattaaacaatttaacttcccctggctgggcgcggtggctcacgcctataatcccagcactttgggaggccgaggcaggtggatcacgaggtcagaagatcgagaccatcctggctaacatggtgaaaccctgtctctactaaaaaatacaaaaaatttgccgggcatggtggcacgtgcctgtagtcccagctacttgggaggctgaggcaggagaatggcgtgaacccgggaggcggagcttacagtgagctgagatggcaccaccgcactccagcctgggcgacagagcgagattccgtctcaaaaaaaaaagaaaaaaaaaatttaacttcccattccccactctgcctagctcctgttaactactattctactttctgtctctatgaatgtgcctattgtaggtacctcatataagtggaatcaagcaatgtttgtctttcctgtctcgtttatttcacttaccataacgttttcaaaattcatccatgttggccgggtgcggtggctcacacctgtaatcccagctactttgggaggccgaggtgggcggatcacaaggtcaagagttcgagaccagcctggccaacatggtgaaaccccgtccctactaagaatacaaaaattagctgggcatggtggcatgtgcctgtaatcctagctactcaggaggctgaggcaggagaattgcttgaacccggcaggcggaggttgcagtgagccgagattgtgcctctgtactccagactgggtgatagagcaagactccatctcaggaaaaaaaaaaaaaaaagattcatccatgttttgtagcatgtatcagaatttcatttctctttaaggctaaacagtattccattgtatgtatgtaccatattttgtttattcatctgttggtgggcatttgagttgtttctacgttttggctattgtgaataatgctgctatgaacatggttctacaaatgtctgtgtctctgctttcaattcttttgggtatatacctagaatacctaaaagtagaattgctggagcatatgataattctatgtttaatatgttgaggaaccatcatgttgctttccacaacgaatataccattttacattccccagcaatgtacaaggtttctccatatccttgccaacacttcttatttatttatttatatatttatttacttagataatagccatcctaatgggtgtgaagtggtattttattgtggttttgatttgcattgccctgacaactaatgatgttgagcatcttttctcaaagttgtagagattataagtcccagatcaagttctagcttggtgggtttctggtgagggctctcttcatggcttggtgaggagagttgggagtgagctttctcttgtcttcttgtctttttttttttttttttttgagatggagtctcgctctattgcccaggctggagtgcggtggcgtgatctcagctcactgcaacctccgcctcctgggttcaagcgattctcctgcctcaacctcccaagtagctgggattacaggtgcctgccaccacgcctggctacttctttatatttttagtagagacggggttccaacatgttggacaggctggtcttgatctcctgacctcaggtgatccacccatcttggcctcccaaagtgctggggttacgggcatgagccactgcacccggcctctgttatctctttttataaggatactaatcctattggatcaaggacccacccttatgacataaaggtcccgtctccaaatacagtcacattggggttggggttttaacttacaaattttggcggaggagagaggacacaaacattccatctataatacaggggaagatctgctgatctctttgtatagttatgccccctcaaaagtgtgagcagagctaaaagactagtgggctgaccagtcttttagtcttgagggtctaaagggtagacggggtcatttttagtctgcagagtaggagagagagttagcttttgcattctaggagaataaggagcaaacacacttcctcgatgtctaacaagatgttagttgttacagaacagccctcaggggagagactgctatagctccatcactcatgggactacataaggtaccccagggctcccctgagtaaatcaaggactcagaagaggattgaatatgaggggaaaataatcacttttctgacttgaattagtagtctcgataatcaaaaagaagtagtatctaaaagtagatatctagtaaaatctggtaaataactagactaaccaagaaaaaagaatcttacatgcacctttcttcttatcttcaatgctagaagctaaaagacagtagaccattaaggggaaaaggctacaccatccaagaatctctaatcaactaagatatcatctcccagggtgaaaaagatattcatggaccatagtgcagaaaactatgtaatagttgaaaagatgaagctagatctatgtaactaacatatgttgacattgaatgaatggaatatttgataaaagtgctaagtaaagactctacagctagaacagaagtgtgtcagggggaggggcaatcatatagaagtggacagtgtaggggtgattaagtcttttttttttttttttttttgagacaaggtctccctctgttgcccaggctggagtgcagtagcagaatcttggcttgctgcaacctccacctcccaggctcaagtgatcctcccacctcagcctcccaagtagctaggactacagctattgggacgtgcctccatgctcagctgattttttttatttttagtagagacaaggttttgccatgttgtccaggctgatttcgaactcctgagctcgaacgattcacctgcctcagcctcccaaagtactgatattacaggcatgagccatcgtgcctgaccagtgattaagtcttctacatgtgttgtctatgtggcatgatagaaaggggggaaatattagtattttagattatttatttatttttggtgaatgggggctaggtgaagtagggagaacgagtagatgagttactttcttaaaacagataaatatgtttgatcttgagtgtctggaaagggaggctatccactagtaaaaaaggaaaaatattatatatctctttgttttttgagacagcatctcactttgtcactcaggctagagtgcagtgtggcgcagtgtggcgcaaacatggctcactatacagtctcgacctcccgggttcaagcgatcctccagcctcagccccctaagtagctgggactacagacatacaccactatgcccggctaatttttgtattttttgtagagacagggttttgtcatgttgctcaggctggtcttaaactcctgagcctaagcaatgcacccaccttgacctcccaaattgttgggattacagatgtgagccactgtgcctagcctgctacatctcttagttaataatagaaaacaacaaagtgaaataaataaagaacataaaataagattgaaggagtaaaattaagtatattatttgctataccaaatgtggacatgttgcatttacttaataagaaactcagattgtcaggtagagttaaaagacaaaactcacatgtgttgtttactaaaatcatacttaaagcagtgataaagaaaaggtaaaggtgtaaacaagcaaagagaaaacaagagtggcaatgtgttttgttttttttttttttgtttttttttttgagacagagtctcactctgtcgcccaggctggagtgcagtggcatgctcttggctcactgcaacctctgcctcttgggctcaagtgattctcatgtctcagcctcccaagtagctgggattacacgcacgtgccaccacacctggctaattttttgtgtttttattagagacagggtttcaccatgtcgactaggctggtctcgagctcctgacctcaggcgatctgcccgccttggcctcccaaagtgctgggattacaggtgtaagccaccacacctggccccaaagtggcaatgttaatgtacatcaaaaaaggaggaaaacaaggttgaaacattagacaggatattatgaaattatatacttcatagtttacgaagatgtatcaaaaacttgtagacatcaacaacattttggctaaataacctctaatagcattttcaaaaaagcaaacatgtatttgtagtgggaaatttcatgtacatttctttcagcataggagagatctagtgcacaaaaagtgagtaaatacagaggagttgtgccaggcgaggtggctcacgcctgtaatcccagcactttgggaggccgaggcaggtggatcacctgaggtcaggagttcaagatcatcctgaccaacatggagaaaccccacctctactaaaaatacaaaattagccggggtggtggcgcatgcctgtaatcacagctactcgggaggctgaggcaggagaattgcttgaacccgggagacggaggttgccgtgagccaagatcgcgccattgcactccagcctgggcaacaagagcaaaactctatctcaaaaaaaaaaaaaatacagaggagttgaataatataatccacaatccacaaactttatttgatggatgtatagaactttatatccttcaagcaagaaatatacattgttatatgtggcccccaaaaacccttaagttaaagcagagagattttgtacttgcattactcaataagattagaaataaataatgaaataaataaccaaaagattcttaactaattagagagcagaaatcacattcctaggtaaattttgaatcaaagagaaactgaaaactgaaaatgaaaatgaaaatgaaaattataaactagaaagcaatgaaaaagagaagacattacaacaaaacctgtgggtcattgcaaaagttgtacctgttagaaaatttatagcctaaaatatcttcattattaatgaacaataactaaaggaatttagtactcatgttaagaaattaggaaaataacagcaaaagaaaggaagagggaattcagaaaaactgaaattaatttaaaatttatatacataaaaataggataaatagattttattattttgggctttctgaaaaacgattaatgtacctgatgaagaaaatagggcagaaatacacaaggaaaggaatgagaaggccgggcgcaatagctcactcctgtagtcccagcactttgggaggaggccgaggcaagtggatcacttcaggtcaagagttcaagaccagcctggtcaacatggtgaaaccccatctctactaaaaatacaaaaattagccgggcgtggtggtgggcacctgtaatcccagctactcaagaggctgaggcaggagaatcacttgaccccgggaagcagaggttgcagtaagctgagatcgcaccactgcactccagcctgggcaatggagcgagactccgtctagaaaaaaaaggaatgagaaataaaacatagcatgctatgaaagagaataaaagaaattagaagataatgtcatgtacaactttgataacaaaatttttctaacattttgttattttaatttaatttttttgagacagggtctcactccgtcaccaaggttggagtgcagtggcatgatcttggctcactgcaacctctgcctcccaggttcaagcaatcctcccaccttaccctctcgagtagttagggactataaacatgcaccaccacacccagctgttgtttttattattatttttttgtagagacgggggtctcactatgttagccatgctggtctcgaactgggctcaggtgctcctcccacctcagcctcccaaagtgctaggattataggtgtgagccaccgtgcccagcccataccttccttttctaactttttgtgtccaaatttttattgaagttctttgagtaatatggtcagagacggtgtatggggtggtgtactgtctgtgtccctgttgtctagaaatgtaggattttttcacttttaaacttgatggatagcttgtctgggatcagaattttagggccatagttctccctcagaattctgtaaaattgttcctttgacttctagcagttaatgtagcagattagaggtccaatgcctatttgaatgtctcactggttcataaactaatatttctgtatggaaacctagagcacttttattttggcaattcagaaatttaattagattaaatgtctagatgtttaacatttttattgttcttgttctgacattacagatgttttagatatggaaactcagggatttcttagggaaactttcctatctgctttattgctttttctcaattcattttgagatactgtttttcaagatactgatttattacccaggtgggtttataatgtacttatgaaatataatagtgctgcattgccatgttggaggagtcacagtagctaataaaggatatctgtgatgatacaagtcttgagaaaagcattgacaggcaaaaataaataaatatacacatccatgcatatatgcaataaagcattcagttgagtggtattagaaatgtgcatgagaattttcatgactttattttggaacttgttattccttttcaggaccgaaagttaaccaaagctgagcagcaaagattcaaggaagaagcagagatgttgaagggtctccagcaccccaatatagttcgattttatgattcctgggaatctatattaaaaggaaagaaatgtattgtattagtgactgaactaatgacatctgggaccttaaagacgtaagttgaccctgatagtgccaatgtagttttatttggaaataattttcaggagtcataacaatttttataaaataaaactactcaaagaatttttagaatctggccaggcgcagtggctacacctgtaatcccagcactttgggagactgaggagggtggatctcaagactagcctgggcaacatggtgaaaccttgtctctaccaaaaaaatacaaaaagtaaccagatgtggcagcacacacctgtagtcccagctactcaggaggctgaggttggaggatggcttgagcctgggagatggaggttgcagtgagccatgattgtgccactgtattccagcctggttgacaaagccagatcctgtctcaaaaaaaaaaagaatttgtagattcgaatctagtgactgttttaagttaggttaaacaattgagatgttaatgaagtttgttaaaaaaatacagtactgagaagttaatgtttgtgggatattatagaattttagaattaaaaatctattatagagaatataattttattttattttattttattttattattttttgggacagggtctcactctgtcacccagactggagtggtgcagtggcatgatcatggctaactgcagcttcgacctccttgggctcaagtgaccctcccacctcagcctactgagtagctggaaccacaagcatgcagcaacatgcctggctaatttttttaaaaataatttttgtagagatggggtttcgccgtgttgcccaggctggtctcgaattcctgggctaaagcaatctgcccacctcagcctcccaaagtgctagggttataggagtgaggcagcatgcccggccataattttattttgtagaagataatggaaggttggagggcttggtcaagttcaaatatctagtgagcgatactattatgatattatagtattatagtatattattatagtattatatagtataatattatagtattatagactattaattatagtcttttatttctaaccacaattattcatttggtgaataatgacttgtaaatattaaatgtggtttaatcacttgcaaatattaaatatggtataaactttttgtttcctaacatttgtgtatatactaaaattttacatagtttaaccctctagtgactttatataagcagttattaggtagtagagaaggactttctttttaaaattgtgctgccattctacaaaaggccactctggaatgatttttagtttgaattaaaaatgctacacttggctaagtgtggtggctgatgcctgtcatcctagcactttgggaggccgaggcaggcagatcacctgaggtcaggatttcaagaccagcctggcccacatggtgaaaccccgtctatgccaaaatgcaaaaattagcttggcgtggtggtgcatgcctgtagtcccagttacttgggaggctgaggcatgagaatcacatgaacctgggaggcggaagctgcagtgagctgagattgcaccactgccctccagcctgggagacagagtgagacttcgtcttaaaaaaaaaccaaccaaccaaccaaacaaacaaaacagctatgcttggtaggatgtcttatctaagaatgaagtattagattaaatttttgttttgccataacagacaatagaaaacaactcagtgatgggaatcatagtgcataagttgtttgcttatgtaacttaccttaatagtgttcatataataagttggatatgtttgtttacacatggtcttttgtttctttgtataggtacttaaaacgatttaaagtcatgaaaccaaaggtcttaaggagctggtgcaggcaaattttaaaggggttgcagttcttgcacactaggactcctcctattattcaccgggatctgaagtgtgacaatattttcatcacgggacccactggatctgtgaagattggtgatctaggattagccaccttaatgcgtacctcatttgctaagagtgtcattggtgattaaagttttacagtttactggttgggtaaagagagatttttcaattgtataggtctagaacaggaatcagccagctatggccagtgggatgaatgtggctcactgcctgtttttgtaaatcgaattttattagaacacagtcacactcactcatttacagattgtctaggactgcttttgcacctacaagtgacagagttgagtagttgtgtgacagagaccatacaaactgcaaaacctaaacagtttactatctggcccttaacagaaaagtttgccaatactgggcttagactgaatttgctttgaaatacctattatatattggcttttttcagagacatcctaatgtattttttgtgggataataatttatatttaggattattgaaaggttctaaggatgtaagtaagagagtttattaagttaattcagaaaaatttaagtaaaaaggatagaaataaaaacattttattaatcgttacctaatcttgagcattacaaattacactctatcagtatggaaaattaaataaattatttcagtgctttatgtagatatagcaaatattcaacaaattgtatacttaaaaatttgcggccaggcatggtggcccacgcctgtaatcccagcactttgggagcctgaggcgggtggatcacgaggtcaggagttcgagaccagcctggccaacatggtgaaaccccgtctctactaaaaatacaaaaattagccaggcatggtggcaggcgcttgtaatcccagctacccgggaggctgaggcaggagaatcacttgaacccgggtggcagaggttgcagtgagctgagatggcaccactgcactccagcctgggcaacagagcaagactatgtctcaaaaaaaaaaaagaaatttgctttgggggagtagaaattaacacagataatccttataggaaaggggatgtgatcttggtggatacgtttttctcttctataagaatgtggtggtggtgttattttgtaggaactcctgagtttatggctccagagatgtatgaagaacactatgatgaatccgtagatgtttatgcttttggaatgtgtatgctggaaatggccacatcggagtatccttattctgagtgtcagaatgcagctcaaatataccggaaagtaactagtgtaggtataacttttttctttttactttatcagttgccacgtttcatgttgaaattagttaagtttgacttactcaaaactaattttggtttagctctaggtaacagtattaaaattaacaattgtaatgcaacaagccttagatttataccatatgactatgcttcattggagtcatataaaatgctctgtattagtatctttgggaaaatgtacaggtatatcatctatatatatttgtttgtaaggaatttttagttatctattagatggatcttatttttcaaagctgaataatagagaccgactacatggtttcttctaggtctaaaagcctttttatgaaagggcattcaaaatatagttcaatagatacagtatttgggtccctgctatgagtaaatttttgtgttagaaattgtaaggaatgcaaacatgagtaagaagtgtttgctaccctaaagagcttacatttctaataagggaataatataaattcacaaatgactataaaataagaggatgagagtatagtaagggacataaggaaggtagaagcaaagtgttgttcaaaggaggactgcttcatatccagttgggcagctcaagacaggctgtgaaagattgtttcaggtagcttaacattagtaggtattggttttttaaatccttttaaaattaataccttttttttttttttttgagacacagtctgtcgccaggctttagtgcagtggcgggatctcggctcactgcaacctccacctcccgggttcaagcaattctcctgcctcagcctcccaaatagctgggactacaggtgtgcaccaccacgcccagctaattttgtatttttagtagagatggggtttcaccatgttggccaggatggtcttgatctcttgaccttgtgattcgcccacctcggcctcccaaagtgctgggattacaggtgtgagccaccgcgcctggccaaaattaatatcatttttaattgacaaattgttattgtacatatttaaggggtaccatgtgatgttttgagatacacacacacaaatgtggaatgattaaatcaggctagttaacatatctgtcaccccacttgcttattattttgtgtggtaagacatttgaaatttactaagttattttgaaatttacagtatattattgttattatcgactgtagttaccctggtgtacggtagatctcaaaacctactcctcctgtctaactgcaacttgtaccttttgaccaatagctccccatttcctcccccacaactcccagtctctggtaaccatcattctactcttctatgaggtcatcttttttagattccatgtgtaagtgagatcatgttgtatttgtctttctgtgctggtttatttcacttaacataatgtcttctaggttcatccacattgtcacaaatgatagaattttcttctttttaaaggctgaatagtattccattgtatatatataccacattttctttattcattcactgatgaacatgtaggtcatttccatatcttggctattgtgtatagtgatgcagtgaacataggcatgcatatatctgtttgacatactaatttcaattcctttgggtatgtaccaagaagtagaattgctatggtagttctgtttttagtttttttggggaagttccataccattttccataacagctgtaccatttatattcccatcaacaacgtacaagggttcccttttctctgcatcctcaccaacacttatctttcatcttttcgataatagtcattctaacagatgtgaggagatactgttttttaatgcatgcggtataccacatgctttatttatttattttttgagaccgagtcttgccctgtcgtctaggctggagtgcaatggcgctatctcggctcactgcatcctccacctcccaggttcaggtgattctcctgcctcagcctcccgagtagctgggattacaggcgtgcaccaccatgcccggctaattttttgtatctttagtagagatggtgtttcaccatgttggccaggatggtcttgaactcctgacctcgtgatctacccaccttggcctcccaaagttctgggatcacaagcgtgagccactgcgcccggccaccacatactttaatctttatcccctacgagataggtgcaatcttcagtttacagatgatgaaactgagaatcagaggttgtaccttgcccaacttcccgcagctactgataatggtgggttttgaccccaagtctgtctgactctagaagtttgtgtaaggagacaataagaaataaggctacaatccagaatgtgggacattctgtaggacaaatgacctagtttctccaacaaatacattttatgaaacaaacaggaagggagggaggcttttatagaatacaagagacttaagagtagtggtgagctggtaaatgtttaacacctgattctctgaagaaagaaagaatgctgacttctagtatttgctgatttttgtggtataagtactcccactatggctgatttcaggttaccaatgtgacctcactgaatgaagagttgggaagagatgcactgttgcactcattgtatggttatttctaccatgcagatagagtagctgtaaataacctcaaacacataaataatagtaaactgtagtaaaatagttagggagtgatgttttcagtatttattgctttggcttttttttgctctgttttgttttgttttgtttttgagacagagtctcactctgtcacccaggctggagtgcagtggtacgatctcagctcactgcaacctctgcctcctgggttcaagcgattctcatgtttcagcctcccaagtagctgggattacgggcatgcgcctccacacctggctagtttttgtatatatatatatatttttttaataaagatgtggttttgctatgctggccaggctggtctcaaactcctgacctcgggtgatctgcccacctcggcctcccaaagtactgggattacaggtgtgggccactgtgcccagcttaccttggcttttaatgtaatttatttaattgtaaacttttataatttagttttattttaaatggccatgtttaacaattggattgcagaatttctgaaaacttaatagcatttgtgagctggtatgagccagctcatgcacaccctaccctatggaccttgtttggatcctgatttgaacaaaccaactgtaaaaagacatcatttagacaattttgaaaatttgagtatggactgggtttcagatatttgatattaaggaattattcatgagtattttaggggggacgattatatgatttttttttttttttggagacagtgtttgctctgtcacccaggcttgagtacagtggtacgatcttggctcactatagccttgacttcctgggctcaggcaatcctctcacctcagccaccctggtagctgggaccacaggtacacaccaccacacgcagctattttttttttctttttatatttttgtgtagagatggggtttcaccatgttgcccagactggtcttgaactactgggctcacgcaatccacccaccttggcctcttaaagtactaggattacaggcatgagccaccatgcctgagctacacgatttttttttaaaaggttcttatctgttagagatgtaaactggaaaattcatgggtgaaatgacgtgatgcctgagatttgctttaaaatattccaggatacaatatgtgtgggggcagatagctgaaacaaggttggcaaaatgttgactgttgttgaaactggtgatggttacacgggacttcattatgctattctactttcaagtatgtttgaaaatttctataagagctcagaaaaagagataaggctagaatgtgtttttagttttggcccatattttggaaggccataaatagaaaagaatttcgtgttagattttgtaagttacagctcctgaactgtttttacgtaggagcagagaaaggcagtaatttacccagagatgagaaatgagtatatcagtgggaaggtcaaagagggctttttccataggtagaataacaggtcaatttttaaaaattttttaaatgtatttattttagaaaatttatttttatttttaattttttattgtactttgagttgctgttttaataggtctattttttgaatagtgactttattattttatagtaaagtcattaaaaatgccatatcacaattcagatttccatctgtcttaagcttctacattttaggaactaaattaactcctaatttcatcatatttgtctacgatgtaatgctgggctttctgattctatgtcttttgaggtagcatgacaggcgtagaagtagatgttagattgcttcattccataacaattattctttccattgtacctttctgcttccagcttaatttggaattttctattaaatgactgcaatgatcttacttgggttattttttaaatcttaaataaaaggtaatagaatataaaataagcagattcaggaagccaacacagttattatagaaacattttgaattgtctggacttcatttatttgttcttgaattcctagaacctgataattagcttgaggtacatgctctcaatattttattattgtttaaggataaaaataatacagatttcttaaatatataggtatatatgttcatatatatacatatatacccatacatacacatatgtatctactgattgccgtctaccgatggcttctagccattctagaagactgaaatatagtgaattgggctgggtgcagtggctcatgcctgtaatcctagcactttgggaagctgaggcaggaggactgtttgagcccaggaattcaagaccagactgggcaacatagcaagaccttgtctctacaaaaaaaaaaaaaaaaaaaaaattagccgagtttggtggcatgcgcctgtagtcccagctactctggaggctgaggtgggaagatcacttgagcttgggaggttgaggctgcagtgagctgtgatcatgccactgcacttcagcctgggtggacagagtgagaccctgtcttaaaaataaaaaaaaaaaaaaaaatatatatatatatatatatatatatagagagagagagagagagagagagagagagagaattggaatgtttgaaatagagaagcctttattttgaattttcaaaagttttttaaaatagcattaattattttctgatttcaaaaaagtatttgtttatggctgggcgcagtggcttacgcctgtaatcccagcactttgggaggctaaggcaggcagattgcctgagatcaggagtttgagaccagtcaggccaacatggtgaaaccccgtctctactaaaaatacagaaaaattagccgggcttggtggcgtgcgcctgtaatcccagctactcaggaggctgaggcaggggaattgcttgaaccagggaggtgggaggttgcagtgagccaaaatcacgccactgcactccagcctgggcgacagagcgagactccatctcaaaataaataaataaataaacttgtttattatatattgttaattgggattatactgtatgtagatttggggatcctatttttccctacttaatagtacattatgagaatttcccatgtcattaattattctgagaacatttttaatttctgtatattgtcatatatacctgcagatctagatttgaaaatcatactatatatataacataatatgtgtaactttgcctctgttgtcagaagtttagattatttaaggtttttttactgttatttgtagacaacatccttgtcaaaaggttattaaacttatgttctctatatatacacatgtatatttaaatatttcatttaaaacttgactatggtttagtgataaaaataatgtttaataaatgtcatgttgacttgggctttcaattgcatcattgttactagaaaccatttttttctcctagggcataaaaccagccagcttcaataaagtcactgatcctgaagtcaaagaaatcattgaaggatgtattcgtcaaaacaaatctgaaaggtgggtgcaattgtagcaaaatgacataactgaaagatgcatttttctcttatcttgcattgggtcgttttctgacctttcagtcatgctgagtttgacttttgagtagaagccaaaccatactctagattgaagtgtatcagtgcatgttgtttaccattttagacttggatatcatgtgctgaatttttcttgaactgacgtttgggttgcgtttgtgtgtgtgtgtgccttttgacaagctttcatcaccttcagccatcagcttaacagtcagtaggccctcacaagttaatttgcttctaacagttgagagtggacaaaattttaaaaatttgattctatatctttagtgtcatgataatgataaagctaatatggatagaagaaatatgtattcaagaaatcgtattccacatttatttgtgtcacaatttgctttatagacaactcccattactcttagcttttgcctccctttaggttttatttcttattttatttttaattttttttttttttttttttgagacagagtctcgctctgttacccaggctgaagtgcagtggtacgatcttgacccattgcaacctctgcctcccgggttccagcgattctcctgcctcagcctcctgagtagctgggattgcaggtgcatgccatcacacctggctaatttttgtatttttagtagagacagggttttaccatgttggccaggctggtctccaactcctggcctcaagtgatccacccgtctcagcctcccaaagtgctgtcattacaggcgtgaaccaccacgcccaacctgcctccctttagtttcagctttggacagttgctgactttaaattggtgggtttgtcttttgatttttacttccttattgatgattattagtaaaggcgatatatccttagtagaaattttcatggggttattggccatttgtatatctttgcagaaatatctattcaactcttttgcccatttttaattggcttgtttggttttttgttgttgagataggagcttaggcatgcttttaaaaatgaagctaaaaacactatatagaagtagctattttagtttggattctgattgttgtttgtacagcctttaaatatgttctattaccaaagagcactggaatattgcaaaggatttatagcatattagtatattgggaaaagcacagtcttcatcatcagacttaaagtcaaatctgggctcacacttagcctgtgtgaccttgaacaagttagtaattacataaaacaagtattattttgataactaaaaggataataggttgagggtagtggcttatacctgtaatcctagcactttgggaggccgaggcaggaggatcacttgaggccaggagttcacgaccagtctgggaagcaaaatgagacccttgtctctacaaaatattaaaatgaaaaaattagccaggcatagtgtcacacgcctgtagtcccagcccctggggaggctgaagtgggaggattgcttgagcccaggagttggaagctacaatgagctatgatcatgtcactgtactctagcctggatgacagagtaagaccctgtcttaaaaacaaacaggctgggtgcagtggcttacacctctaataccagcactttgggaggctgaggcgggcagatcacttgaggtcaggagtttgagaccagcctggacaacatgacgaaaccccatctctacaagaaatacaaaaattagctgggcgtggtggtgggtgcctataatcccagctactctgggggctgaggcaggagaattgctcgaacctgggaggtggaggttgcagtgagccgagatcttgccactgcactccagcctgggcaacagagtgagactccatcccaaaacaagcaagcaaacaaacaagcaaactaataaaccaaaataattctactgtaaataataaaaattttacagtaaaaattcactataaataatacagtaaaaatttttattgggaagcagagggctttacttggttgtgcctccttaaacacatctcgctttagtcttagggacgggcacagtggctcacgcctgaggctgagtggggcggatcacaaaatcaagagattgagaccatcctggccaacatggtgaaaccccgtttctactaaaaaatataaaaattagctgagcgtggtggcacacacctgtagtcccagctacttgggaggctgaggcaggaaaattgcttgaacctgggaggtggaggttgcagtgagccaagatcacgcgactgcactccgtcccaaaaaaaaaaaaaaaaaacaccaaaacacacatctcattttagtcttaaaagtaattcatttgagcaactttttctttttcaaaaaaatcaactttgtatggaatgatggcttattctatttatgacaccatcttagttaagtatttgtcacttggtcactaaaaatgtagggggttgaaaatcctcaacttacaggatatcatgctgtgtatatactttttctgtttatgtagtgtaagaagaggtctctgtagacattatgcagtacatcagtttcagctctcactggcctgtaatacagagagtttaaatattatgtatctgttttaaaagttagtaaaagtaaattaacttgtccagcttgtaaacaaatcttttgaagctatgtcctttgtttctcttcagagatggttaatccctaatactaggctagggttgtatctgttatatgtatactctggtctaaaaccagagttaaatacgaaaaccactggactttgctgaaccacattagcttcacccatggcattctgtaaagtactttgactagattattgttaatggagacagtgacttctatttataacattcgtaaaaagagtttgaatttttaacgtactttagagtttataaatctgcaagtttttggttccctttgctgagaatctactgtttgagtctgagtaacttaagccagtggcttagggaaatttgcctaacatgtactaagctacttctccagttctcactaggcataattttgtgtatgttaaactttgttatttagatgtattacttgtaagaattcatttttaattgaagtcactccgtatgcatgttagttgggatttctttgcatccctggtaataaattggatataagatttattgttgtttttgcttccacaggatctgttaaagagatttggtttttataacaaggcagattaatgattaaattgatagaaaatttcaaataagttttttgcttttatacaattaatttttagtaattaaagggtcttgctatgattggaagaactgataatgagatatatgttttgtttattaggttgtctatcagggacctattaaaccatgcattttttgctgaggatacaggactgagggtggagttagcagaagaagatgattgctcaaattcatcccttgctttaagactctgggttgaagaccctaaaaaattgaaaggcaaacacaaagacaatgaagctattgaatttagtttcaacttagaaacagatacacctgaggaagtagcatatgaaatggtaagttaatcataccactattcccctcacctcttattgtatcagagttcattccttgctccttctcattgctttctttcctctcattttctccttttttttgagacagagtctcgctctgtcacccaggctggagtgcagtggtgcgatctcggctcactgcaagctccgcctcctgggttcatgccaatctcctgcctcagcctcctgagtagctgggactacaggagcccgccaccacgcccggctaattttttgtatttttactagagacgggatttcaccgtgttagtcaggctggtcttgaactcctgaccttgtgatccgcccacctcagcctcccaaagtgctgggattacaggcgtgagccatcgagcctgaccttctccttttttctttaaattgttatgttgttgtgaactatatcgctgtgacagtgtattaaatttgtatgtagagtataaagaataataaagctctacatttattaagaaatagaacattaccattaccttaaaagccacctgagtgcctctctcatttgcattttcctccctcatcaccatgagtaatatctacctagattttttttttttttgagatggagtctcactctgttgcccaggttggagtgcagtggcacaatctcggctcaccacgacctctgcctcccgagttcaagcgactctcctgtctcagcctcccgagttgctgggattacaggcgcctgccaccactcccagctaatttttgtacttttagtagagatgtggtttcaccatgttagccaggctggtctcgaactcctgacttcaagtgatctgtccccacctcagcttcccaaagtgttgggattacaggtatcagccactgtgcccggcccctacccagacttttgtgttactcatttctttgtttttcatcatagtttacctgcataatatattgttttgttttgaaaactgaatggcaagcatgcacctagttggtgggaaggggcagtattggtacaattaggtgaagagtcccaggagaggataagctgaagagactttctcagttatagcaattccagcttcagtttccctaagagtttacaagagctacttctggagaagtcagagggtaaggttctaaatgaggccaggaaaatacacccatgtctcagcgcagtcagggcaccggcagggctagtgtgcagaccagaaattagttgtctggttaccatatggtttgatggggagtgggccactctgactctttgcttccaatctctctgtgaccagcccccactctcaatagtggatcacagaaggcaacttctgtggggtgaaatgcatgtccatacctgctccaggcagctgcagtgctgatgggagggtgtgcaggagccgcagcagcatgtactcaaaaccagccgagtacaaaccatctgcgccaggctcacctgggcattctggcctcaggttaaaaagaaggatggggcaatgacagtgggaacctggaaatgatagcctttaacatgtctttctgatcatactgttgttctaaactggaatgattattttggacatctggtacacaactatcaccctggcatttcccattaccatcttcctagacttctctgcttcactcctgtatttaattttggatttcctgaatcccatgtcttcaggggacatgggattagctgggtccactttcagctcctagaagccactcttcagtcctttccatgtctccaccccgtcttcaaagccagcaatggcatattgaatccttctagtgtcagcagctggtaaaagattcaccgagataatctccctagattaaggccaattgtgctatatattatagcaaacacaatgatgggagtgatatctcatatgcacaggtttggggattaagagggatcatcttaaagcagattgcaggactgagaatgatatgtcatggtacctcctcaaatgatcttctctactgttcagccctgttcctctgagatgacgaggcagaaccttttcttctctcactcctctaatgcctagtaagatgtagcactttgctgttagcatacttgcctctgcctagaatgttggtctccactccaaacttctgcacatccctcaatagtgtgcacgttccttttttggctttaattcaggtcagaacttaccttccaggctggatgtggtggctcatgcctgttatcccagcactttggggagaccgaggtgagaggattgcttgagcccaggagttcgagaccaaagcccaagcaatatagggagaccccatctctacaaaaaattaaaaattagccaggtgtggtggtgcatgcctgtgatcccagctactcgggaggctgaggtgggaggatcacttgagcctgggaggtcaaggctgcattgacctatcattgtaccactgcattctagcctgggcaacagagtgagaacctgtctctcaaaaacaaatcaaataaaatagaattcttttgtgaaaacacttactctattaccttcagagatgcagcgtgctcctacttaagacttttacagcagctcatttcaagttaagttatgtccatttcacaccacctgatagtgtgctcatacaggacaaaggaccaacttagtcacctgtatctggtgcctagtactgtgcacattgtagacacttaatgttgctgaatgaggaaacctttttaatccttcaaaaaacgtaatggcagttctaaattacctgtgataagactgcatattctgaaacatcaagttgttttgttcgtttttgtttaaagcctgaattattttaacaatgcttggtaatactattgatttttctcatgccaattagaggctctggcatttatgtatgtctttgtttaagagagaatatagaaacagattaactgttaatttggaatttgggggcataaaataactgctagtaaaaaaaaaaaaagttaaaattggccgggcgcggtggctcatgcttgtaatcctagcactttgggaggctgaggcggtggatcacgacgtcaggaattcaagaccagcctggccaacacagtgaaaccccgtccctactaaaaatacaaaaaaattagctgggcgtggtggcgggcacctgtaatcccagctacttgggaggctgaggcaggagaatcgcttgaacctaggagacagagttgcagtgagccgagatcatgccactgcactccagcctgggcgacagagctagactctgtctcaaaaaaaaaaaaaaagttaaaatcttaaatgttaaagaagtagtttgcttattatgttttgtttgtaggtcaagtctgggttcttccatgaaagtgattccaaagctgttgctaaatccattagagaccgggtgacgccaataaagaagacaagagagaagaagcctgctggctgtttggaagaacgcagggattctcagtgcaagtctatggggaatgtattccctcagccccagaatacaactttaccccttgctcccgctcagcaaactggggctgaatgtgaagaaactgaagttgatcaacatgttagacaacagcttctacaaagaaaaccacagcagcactgctcctctgttacaggtaacacagttacagcttgtaaaagcaaacgcatgtgcaattatattctctaatctttatttattttgaagggcagtggtcaatgacctattttgtttcttttcctttttgtatgtttgcttatctttaaatagcacttctgtgctctaaatagcacttctatcatttcatcaagccttttacaaaacccctgaaatagacaagccagctagtttccttattttaaaattaagaaactgttttgttaagtgattcttctaaggtgctagttgcagaaggatcataatctagcatctggttttgtttggggtataaataaaatgatcttattatcatttttgagggtctaacataaatcctttcttttttttgagacagggccttgctctgtcacctaggctggagtgcagtggtgtgatcatgattcactgcagcctcgacctccccaggctcaggtgatcctcccacctcagccccctgagtagctgggactacaagtgcgtgccactacacctggctaatttttgtattttcttttggtagagatggggtttcaccatattggccaggctggtctcaaactcctgggctcaagccatctacccgcctcagcctcccaaagtgttgggattgtaggcatgagccaccgcgcccagccacgtacatcgtttaataaagaaaatttagaactaaagataaaatttattcctcaagaaggaattttctagtctttaagaccctttgtattttaggctcaagtgtaacattaacacaattcctctaattttctgctgtaatgcattttcttttccagaaggacacagtatttgcatagtaataacctattgttctacaaagacagtattctaggttataggagaaagagaatatgatatattttactgaaatccttatgtcaagtgtagattagttagggatatacatgacatggccagcaaatggagttgatttttatctgattctctgtttttaggttggctttactaagaaaattttagttataccacaatgtcaacatttcattgcttgataagagtttacatgctggtttttgattaatgttgtagtgtaaatattttatttgaagctatgtcaggttctcagagtaaaaaagccattaaagaaacaccattacctataccatttggacattttgtgcttcaagttttcccttctacctgttacttattttctttttttataggtgacaatttgtctgaggcaggagctgcatcagttatacattcagatacttcaagtcagcccagtgtagcctattcctcaaatcaaacgatgggctctcaaatggtttctaatatcccgcaggctgaagtaaatgttccagggcaaatttattcatctcagcaactagtaggacattaccagcaagtttcaggggtgaggtgaactgttatatttttaaatatataatcagtgtatttactgtaaatgggaaagtttatctttaatctttttttccccttattttaacagttacagaagcattcaaagctgactcagccgcagattttgcctttggttcaaggtcagtccactgttttacctgtacatgtccttggaccgacagttgtttcacaaccccaggtttccccattaactgttcagaaggtcccacagataaaggtaagacacattttagaggttctgtattcatttaaacaaattaaacactgcctagattttctgacaggcaaaagttctcttttataaattcattatagtttagagaaaggtcaccaaaagctaaaagttgtttatgctttccttcacccaagacattccttttttttttttttttttttttgaggtggagtgtcgctcttgctgcccaggctggagtgcaatggtgcaatctcggctcaccgcaacctccacctcccaggttcaagtgattctcctgcctcagcctcccaagtagctgggattacaggcatgtgccaccatgccccgctaattttttgtatttttagtagaaacggggtttctccatgttggtcaggttggtctcgaactcccgacctcaggtgatccgcctgcctcggcctcccaaagtgctaggataacagacatgagccacagtacccggcccaagatgttcctcttaatgtgtctaatattgtgtaactagaatcttgagatactgcttgtataattggagaagaaacagagaactcagtatatatggacaaaagatttatttaggactgatctcttcctcttattcatgattatttgttctttgtattaaacttttccagcctgatttgaacatggaaggatgtctgttgcagttaattagaaatagtgtttcatagattttcatgatttttagcatgttcatctaaactcttgacttgttttggttcatgtttatttctgtaggagaaataagaagtgtttttgtctttcagactcttaaagtcagcattattcatttctgacaatgagttaatagtctttgtgtgagtttatatattaagactatatcctggttccctaggttatggattctggatgcatggttgcatttttctttgccattacccggttttctcctctcacctcccaccataccttgcgtttgtcttccttctctgggagtgagatgatctaatagctgctagctaacagagaatgcctgatttagctagttgctggtgcatcttttaagagattagtatattatcagttcatcatcaaacttttaatgattaccaccttctggggatatgaaataaaataaacatgatccttgccctcaaagagcccagtcttttaggggaaagcatgtatgtacttgacaaatgccagatgcatttaaaatctgctaggggtagatttagtttgatatagttgaagatgccagatatttggctagtatttataagtgatatggtgcctatttgtaattgagctcatgtggtagtttgatttgcctctttctaagcctataatgcaaagtgtgttgaatgggagcttaaatttaacttaggttcaatttacataagcatacaggtatgtgtattttaaaatgtgttccaaaaatttaattatcaaaatgttacttgcttattttaaaataaagcccataaagttatgaaaaagaaagtgaaaaattacttgttatttctccagctagagacaacttattgttttttcattttgttttgttttgtttcgttttgttttgttttttttgagatggagtctcattatgtcgcccaggctggagtgcagtggcgcgatctcggctcactgcaacctccgcctcccgggttcaaacgattcttctgccacagcctcccgagtaggtgggactacaggcacgtgccaccatgcccggctaattttttgtatttttagtagagacgggctttcaccgtgttagccaggatggtctcgatctcctgacctcgtgatccgcccgcctcggcctcccaaagtgctgggattacaggtgtgagccaccgtgcccggccaacaacttattgtttatgtttgaggtatagcctttagatttatctttttttctgtgtacacatgtataactttgtttatatatacacatgtatatcacatacatatgattttttgtagcctgcccttttcacctaatatatagaagccacataagcaagaaatttgattatatgggtctttttatgagcatggtagcccaaattctaggaattattgcagccaatcagtatttatttctgccaactctctcctctcttcttgagagagtatctatattcattttaggaatgatactgaaatcctttgagctttctcatgggacttccactgtcaggtgtgtgacaatgtcagattcggatactcagaatctctgccagggtttgaatgagttatgtagtaaattgcgataaataagaaaccatgagtggtatattgctgtgacttgtctcaaccccttagtgtattcagttaactagcatttactcatggtattaggatttttataggactaatgctatacctagcacctttttgataatttgctgaaatttttggaacatagcattattttctctatcagtatgtccgggaaagtcccattaaaatgggcatagtatatgcatttataatttgaattctccttgtacctgtagctggcctttggagcagatagaaaaactttagcccaacctatgactttagacttgtcagttactggagttccacaatcagtcctttctttcttttttttttttcagacagagtctcactctgtcacccaggctggagtgaagtggtgtgatctcagctcactgcaacctccgcctcctgggttcaagcgattctcccacctcagcctcccaagtagctgggactataggagcacaccagcatgcctggccaatttttgtatttttagtagagatggggttttgtcatgttggccaggctggtcttgaactcctggcctcaagtgatctgccccgccttggcctcccaaagtgctgggattacaggcgtgagccaccatgcctggccacaaccaatcctttctgcagtttctcttcagacgttttctgcttcacagatgacttcccagcatccaacagttggtcttcaacttgagcgtgatcctagaaatgggaatcaggcattaaccaaagcaccagatgccagtcagacttctagtttcttaccggttaatcaccctcaagctttgttgaatcattcttctgtccaacatgtgagcagtgcacagaatgctgctagtacagctcagctcccttctaattccattggggggcattcaggggcccatcagccttcacaaaagatacattcagtatcacagccatacccatcagaagtctctaacttcagattcttcaatgccacaaagccagactgtgcaaggagtattgtttccaagcttgtattcagcaacaatcattaattttacaacctaagattttggcatctccacagaaaaatgttcagcaggattatgttctccaagagtctgaagctcttgcaagtcagcaacagccaaagggtggtattgaaagtgtgattcagcccctggaatagccttcttattctgttcaacacacttccagggccacctgcggaattatcatccttcccattgaaggctcctgagcagctgccctttgtgatatgtccccagcaacaaacttcttactcatcacagccaacttactcaattcaggctccactacataaacagcctgtttattcactgccagtcctggagcatcctctttacactgtacaaccaccgagatcacagccagcctattctgtgcagacttcttatccagtcccagctgcagtacagccctcatatttggcaaagactcacgtgcagtctgcttatctagtgcaacctctgcttcagtcaccttttccagaccaggcagcatatgcaatccaggcagcttaccttatgcaacctatggaacagcttgcttatcagacactgtctcttgagcatgtatcttatttaggacaaactgcttacactatccagataactgaacatgcaaccttcataacccagcaggtatatacaataagccctcctgatagcaagtgagtacacatgacagacaaactctgcacatcagaagttatactctgtaccaccatttgtagcacagacttttgagcaacaagcctatttaacacaaccccaaggtagttcttcttcaacattggaacaaaggatgtatttaataccaaccttagatacacagacacattctactgagcctttatttaatgtccagctttcagcgactccatcccaagcagatgtcagttttggacaccagcagctaaaaactcaggcccaggcaactagcattatatctcagagggcagtggaaggacagcttcaaaaccctgagcagatgtccttcattcagcaggcctcttcacaggcacagatccagcccccacatttctcagcacagttttcccaatcacatctagcaccaagccaggtttttcacttagctttcattcagcagcagcagatgactcattcatctcatagacaagcacaggaaacccatcagttgtctactcaggaaggtcccataaatcaacagcaatctttatttagtcaacatgctgctctccagcagcaggtacctcattgacaggcacctaagcaagttcagccattaccaggtattccaaacaccattacaaacatggtccagattatacatccattgcaagaacagttgcaactggcagccctggaacaacaatatataatacagcctttagagcagcctcaagtacttcaggcactagataacagtctgacttttcccctacagaaaaacctagcacaataccagccagcatacatccagcagcagtctgctgactggccgcagtggtagccatcttacagcttagcacctgtttctgggtcatcagagccacaattacaacagcagaccctctatcaaagctctgggatagcccttccaaatcagcaatcttcagttcatctcctgacacttagcattctggtagacgcttccactgcttttcagagcatttctgtgttacacacacagcagcatttacaaggccaagaaattccaacggtaaatcctcgtgggggaaaataaggatgattgtgatttttctgtgatgtttaagggtcaggatgatagtgaactataatagatacagcacttcagtgggagtcatggtccctgttcctgactcttttccttacttactgagtgaccttgattcaggtcttttctaaattttctcatctgtaaagtgaagggatcagaccagatgactacaattaaaaaaaatttgaggacctacttaggatataacagtgaataaaatacaaaaaccccttctgtcattgaggtttgttgtctaatggggaaagattgtcaataaccactataaaaaggaaattatacagtacaaggtgctttggggaaaatgtagaggaggaaaaggaggaaagtgggttgcaggtttaaggaagatggctatcagagtaggtctcattgagaaggtaacatttgagcagacacttgaaggaaataagggagtcagtaatgtatatttcagacagagggaataacaggtgcaaaggccctaagggagaagtttgtctggcatgtttggaaaacagccaggaggcaaatgtagctttccaagatcctttagtcctaaaacgtttggaacctatggttctcttattgttctacatttataataaagcatttgcctttgtgagataatactattgagtgattcttattgccaaatactatcccaaaggcattacatgtacatcttcacaccaaccctaggaatcccattattacctttttttactgatgaagaaactgaggttcatagaggttaagtaacttttctagtgtcatacccaaaagctagcatttgaacccagcatattcaatcattttactacccatctgctttgaaagatagttaccctccccaccagaattggagaaaaaggttatgatggcttcagtgagatttagttaatttggggaattgattgctttttttttttttttgagatggggtcttgctctgtcacccaggctggagtgcagtggcgccatctcgggtcactgcaatctctgcctcctgggttcaactgattctcctgcctcaacctcctgagtagctgggattacaggcatctaccaccacacccagctaatttttgtatttttagtagagagagggattcaccatgttgcccaggctggtctcgcactcctgacttcaagtgtttcacccacctcagcctcccaaagtgctgagatcacagacgtgagccaccatgcccagcccttgattgaattaattaaagcaaagaactgagaatctgacttattctttttgctcttctcccctgctttaggtatatctaaaacacactgaatttattgtttggctaataaaatactttgaggtccttagataaaaggtgtgctatgctgtatgagttattttctagtgataatatattactctaccaaacagctattacctcaggtattctgtattttataaaatctcctcttcatcaagggcataaattataatggatttcagtatgtgcgtgctgactcctaacaggactgagcgagaataaataaagatctttgcagctgaagtttcttcagacaggggcatactattctgggatttatttatttcagattaaggggtttaacaaaccattttttcttctccccccccacctttttttttttgtttgtttgttttcctgcactacacagatgtaattaacaaagtattttggattttaatgttcattctgtgggcagattgcacgtgttgtatactttccttacctaattaaaacgttttccccaacatcttattaagaaaaacttcagatatacagaatattggaaaaaattgtagcatgaacacccatatacctaacacctaaattatacagttaacttttgctctatctgctctatcacatacctatttatccctttattaatccattttatttttctggtgcatttcaaagtttaaaggaagttgccaacatcagtatacatcatccataaatacatatcattgactagaactcagtatttatgttttttagtttaaatgtatatacagtaaaatgcataaatcataattcatgagtttcgacaaatgcttacacctatgtaaccccaaccattatcaagacatagaagaggtgttgacagtctttttctgtaaaggcctagatagtaaatattgtaggctttgcaggctatataatctctgttacagttactcagttctgctgttgtatgcatgaaaacaaccataaatatgtaaacaaataggcgcggctgtgttccaataaacatttgctcacaaaaacaggtggtgtgccagatttggcctgaaggctgtggcttgcccacctgatagagaatattgccattactccagaaagttccctcatgccccttcccagtgagttttctccacacccgttagagtcaatcgctgttgattatttgttgttgttttttgagacaaggtcttcctcttttgcccaggctggagtgtagtggtgcaaacacagctcactgcagccctgacctcctggctcaagccatccttgcacctcagcctcctgagtagctgggaccacaggtgcgcaccactccgcctggctaagtttttgatttttttatagagacggggtcttgccatgttgcccaggctggtcttgaactcctaggctcatagggtcttcccacgttggcttcccaaagtgctggaattacagatgtaagtcaccatgcctagccaattttttcaccatagattagcttagcctgttctagaccttcatataaatggaacaatataatatatattcttgtgtaaggcttctctgattcaacatgtttttgagattgatccatgttgtgtatgtatcagtagctttttttttttcttttttgagacggagttcgttcttgttgctcaggctggagtgcaatggcttgatctcggctcactgcaacctccacctcctgggttcaagtgattctcctgcctcagcctcccaagtagctgggagtacaggcatgagccaccacgcccggctaattttgtatttttagtagagacggggtttctccgtgttggtcaggctggtctggaactcctgacctcaggtgatctgccagcctcagcctcccaaactgctgggattataggcacaagccaccatgcccagccagctcattcttttttgtaactgcagaataatgttccattttatggatataccaaatttgtttatctatcctattcacagacacctaagtgatttctggttttgggctattgtgaataaagctgcaatgaacatccctatataagtttttttttttgtaaacatgttttcatttctcttgaattatacctagaaatagaattgctgggtcatagaataagtgtttgactttttaagaaattgcaagttttccgaattggctgcactaacaccagcaatgtatgagagctccacaccctcaccagcatttttaattttagttattctagttgttgtatagtggtatctcatcgtggttttaatctgtatttccccgatgactatgatgttgagtaccttttcatgtatttgttggcctttgtatatctttgtgaagtgcctgttcaagtcatttacccattttatttgctcatgtttgtctttttattatggatttacagaaattccttatatatcctggattatacaagtcccttgtcagatacatgttttataaatatattctccagtctttatattgcccattcgtttttgtaatggtctcatttaatgagacaaagtatttaattttgatgaagtctgattcatcaaagtttttctattgtagttactactttctgtggcccatgaaacctttgcctacacccaagttacaaggaaactttcatatggtttatagttttatgtttaagtccatggttcatcttgaattaatttttatgaatgctgtgaagtaaggggtcaagtttctttttttttttttttcctctaggaatatcctaacagcttcatctgttgaaaagacatccctttctccacatctctaccaacacttgttatctttttttttttttttttttttttgagacagtcttgttctgtcgcccaggctggagtgcagtggcacgatctcggctcactgcaagctccgcctcccaggttcacgccattctcctgcctcagcctcccaagtagctgggactacaggcgcctgccaccacgcccggctaattttttgtatttttagtagagacgggatttcaccatcttagccaggatagtctcaatctcctgacctcgtgatccacccgcctcggcctcccaaagtgctgggattacaggcgtgagccactgcacccagcccatctgtcatttttattgtagacatcctagtgggtgtgatgtggtatctcattgtggttttgatttgcatttttctgaagactaatgatgttgagcatctttctatatgcatataggtcgttcatgtatcttcttttattatctttggagaaatatctattgaaatcctttgcccagtttttattttattcttttattttattttttgtagagatgaggtctcgccatatagccctggctggttttgaactcctggtctcaagcaatcctcccaccttggcctcccaaagtgccaggattacaggcatgagccactgcgcctaacccctttacccagtttttaattgggtatctttttgtctttttattgttgagttatgagttctttatatattctggatacttagaccattatcagatgtatgctttaaaatattttctcccattctgtgtgttgtcttttcaccttcttgatggtgtcctttgtggcataatttttttaaaagtttgataaagtccaatttctcaatgttttctttcgttactttgtgcttttggtgtcatatctaagaaactattgtttgatccaaggtcatgaagattttctcctatattttcttctaagagttttaaattttagctcttaaatttgggtctttgatccattttgagttaattgttgtatatagtttgaggtaggggtctaatttcattctatccatgtggacatccagtttttccagtgccatttattcaaaagactattcacccattgaatagccttggcacccttgttgacaatcaattcaccataaaagtatgagtgttccaacttagttttcctttctcaggattattttggttcctctgagtcccttgcatttccacatgaattttgggatcagcttgtcaagttgtgtccaaaaagccagctgggattttgataggcattgtgttaactttgtatattgcttgggtagtattgtctcttagtaatatgaagtcttcgagtccaggaacatggatgtcttttcattaaactaggtgttctttaagtgttggcaaaggtgtggagaaaagggaacccttgtacactgttgatgggaatgtaaattggtgtagccattatggaaaacagtatgaggctaggtgcagtggctcacacctgtgatcccaatactttgggaggctgaggcacgaggatcactttagcccaggaattcaagaccaacctgggcaacatagtgagacctcctcgtctctacaaaaaaattaaaaaattagctaggtgtggtggcatgtaccccatagtcccagctactcaggaggctgaggcagaaggatcccttgaacccaagaggtcaaggctgcagtgagctgtgattgcaccactgaactccagcctgggcaacagagcaagaccctgtctcaaaaacaaacaaacaaaacagtatgaaagttcctcaaaaaattaaaaaaaaaaaaaactatgatacaatccagccattccacttctgggcatatatccaaacgaaaagaaatcagtatcttgacatatctgcaacctcatgttcattgcagctttattcacaatagccaagatatggaaacaacttaagtgttgacagatgaatggataacaaaaatgtggtgtgtgtgcatatacatacatgtatatgtgtgtatacacacacatacaaagaaggaaattcaggaaatcagccactaaaaaagaaggaaatcctgctatttgtgacaacatggatgaaccaggaggacattatgctaagtgaagccagatacagaaagatactgtatgatcttacttatatgtggaatctataaatatcaaactcatagaagcagagagtagaacagtggttggcaagggctgagaagtaggagaaatggagacacttggttaaagggtataaacttttacttataagatgaataagttctagggatgcaatgtattatttagttgaaaaaaaatttttttttgagtcagcgtctcactctgttgcttaggctggagtgcaggggtgcaatcttggctcacacaacctctgcctcctgggttcaagtgattctcatgcctcagcctcccaagtagctgagactacaggcgtatgccaccatgcccagctaatttttgtatttttagtagagatgggatttcaccatgttgtccagactggtctcgaactcctggcctcaagtgatccgcccacttcagcctcccaaagtgccgggattacaggtgtgagccactgtgcccagccctaaaagagatcttaagtatcctcaccacacatacacgtacaaagggagggtaactttgtgttgtgattgatatgttaattaattttattgtggtaatcatttcacagtgtatatgtatagcaaatcatcacattgtacatcttgaatatatacaatttttatttgtcaattatacctcagtaaagctgggaaaaaatagctggtttttaatttcagcagtattttgtagttctcagaaaatcttttttttttaatttttcaacttttattttagaatcagggagtatgtgtgcaggattgtcacagaggtatattgcatgatgctgaggtctgggatatgactgaactcatcactcagatatggagcatagtacccaatggttagtttttcagcttttttccccatccctttctctcccctctcatagtccccagtgtttactcttttcatctttatgtccacatgtacccagtgtttagctcccacttatatgtgagaacatgtgataatttggttttctgtttctgtgttagttcgcctaggaaaatggcctccagctgcatccttgttgctgcaaaggacatgatttcattcttttttatggctgcatagtattccacaagtccttacaattccttgtaaagttttttcctaagttattatttttgttgttattataaatggaattgttttcttaatttccatttggattgttaattgctaaggcatacaaatacaactgatttttgtgagtttccattatatcctgtaattttgctaaatttgtttatcagctccaatagtttttttgtagattctgtaggaatttctctaataaaatcatgtcatctgggactagagatagttttaattttgctttccaatttatattttttttttttttgagacagagtcttactctgtcacccaggctggagtgcagtggcacaatcttggctctctgcaatctccgctccccgggttcaagcgattctcctttctcagcctcccgagtagctgggattacagttgcctgccaccgtgcccagctaatttttgtatttttaggagagacagggtttcaccatcttggccaggctggtcttgaactcctgacctcctgatccacccgcctcggcctcccgaagtgctgggatttacaggcgtgagccactacgcccggcctagatgtttattttttaaaaaattattcttgctggaacttctagtataatgttgagtaggagttgagagcaaatatcctgcttttcctaatcttagtgagaaaattttcagtctttcaccattaagtatgatgttatctgtgtctttttacttttaaagaactttattcaggcttagtttatgtacgataaatgcatatatttatagtgtacagttaaatgagttgacagatgtatgccataatcaagatacagaacatttccagaacacccaaaagtttcttgtgtcccttttcagtatttgtatgtgtgtgtttactctagggattttaatttacattctgaattcttcacagtttttacatagatttaatattataaaatgtaaggaccatgcaactatttatttcctgcaggctttaagctataattatttttgtttgtttgtttgttgaggtaggatgtccttctgtagcccaggcaggagtacagtggttcagtcacagctcactgtagcctcgacctcccaggcccaaacaatcctcccacctcagcctcccaggtagttgagaccataggcatgcaccaccacacctggctaatttttttaatctgtgtagagacgggtctccctgtgttgcccaggctggttataattgttatgtatattacatctacatacattataaactgcacaatgcaatgttatagtttttgccttatataaacatatgccttttccaagaaattacgaagagaaaaagttttaaattttggtgaggtccagttttttttttttggattgtgctttttgtgtgaagtctaagaattctttgcctagccttagaactggagatattcttctacttttacatttttcatttcagtgtgatctatgttaatgtttttatttattttattttatttatttatttatttatttattttgagatggagtttcgctcttgtcgcccaggctagaatgcgatggcgcgatcttggctcactgcaacctccgcctcccgggttcaagtgattctcctgcctcagcctcccaagtagctagaattacaggtgcccgccaccacccccagctaatttttgtatttttagtagagacgtggtttcaccatgttggccaagctggtaaactcctgacctcaggtgatccacccgccttagcctcccaaagtgctgggattacaggcatgaaccaccacgcccggcctatgttaatgtttttttaagttagaggcattcacaaggtaatatgttaatcttgtatatggttttgagatttagattcagggtttttttttggggagggagtttccctgtagatgtttaattgccatagcatcattgaaaacactgcttgtcttccattcaattgcttttatatttctgtcaaaaatcagtttggcttatttgcgtgggtcttttcttctgggttctctattctgtttaattcatttatgtttttaactctctgttaattacatactctcttgactactatagctatatagaaagccttaatattgggtagtgtgattgctacccaatattctttattctttttttaagtttttttttttagctcttctggatttctgtttttccatatacattttagaataatctagtctatgtccacagaaaaccttgctgggattttgatagtaattgtattagtcctatatatgactttggggaaaattgacatcttgactatgttgggccttcaagttcaggaacatgatatgtctcttcatttatttagatcttctttgatttctttcatcagcattttgtaattttcagcatacaaatcctaaggctcttttgttaagtttgtgcctaagtatctggtttaattttgaaggattataaataattgtgctcttttttttttttttttctgaggcagggtctcactctgttgcctaggctggagttcagtggcgtgatctcagctcactgcagcctctgcttcccaggctcgagcaatcctcccaccacagcctcccaaagtagctgggactacaggtgcatgccaccatgcccggctaatttttgtacttttagtggagatgaggttttgccatgttgcccaggctgatgttgaattcccgggctcaagcggtccacccacctcagcctcccaaagtactaggattacaagtgtgagccactgtgcctggctaatattgtagtttttaatgtcagttttcacatgttccttgttagagtatagaaatgtgatcgtgtgtgttgatgttgaattcaaataccttgttgaacttacttatttgtcctaggaggatttgtttgtttttttggtagaatccttggaaatttttttaaatatagaaaatcatggccgggcgcgttggctcacgcctgtaatcccagcactttgggagactgaggcaggcagatcatgaggtcaagagattgagaccatcctggccaacatggtgaaaccccgtctctactaaaaatacaaaaattagctgggcgtggtggcacgtgcctgtagtcccagctactcgggagactgaggcaggagaatcccttgaacccaggaggcggaggttgcagtgagccgagatcgtaccacctcactccagcctggcaatagagcaagactccgtctcaaaaaaaaaaaagaaaaaaagaaaatcatataatctcctaaaatagagacagtgtgatctctccctttctaatctgtatgctttttatttcttattttccttttattgtgctggctagaatttccagtactgtactggaataagagtggtgagaatgtactgtcttgaataagagtggtgagaatgaacttccttgctttgttccgagtcttaggggggacaagtctttcaccattagtatgatatgagctacagattttttatagatgctctttatccagttgaggtagttaccctctattacctgactcactgagaagttttattatgaattaatgttggccaggcgcggtggctaacacctgtaatcccagcactttgggaggccgagacaggtggataacctgaaatcaggagttcaataacagcctcgccaacatggcgaaaccctgtctctactaaaaaatacaaaaattagccgggcgtggtagtgggtgcttgtaatcccagccactcgggaggttgaggcagggagaattgcttgaacctgggaggtggaggttgcagtgagctgagatcgtgccactgtacttcagcctgggtgacagagcgagactccttctcaaaaaaaaaaaaaaaggaatgttgcctttttcagatgtttcttctgtgttaatgatatgattatatggttttgtttttttttacttgttgatatatagtggatgacatggatttcaaatatcgaaacagccttcatgtccttggaataaactcatttggtcatggcatatgattctttgcatacattgtttgattcactttactaatactttgttgaagatttttgaaccttaagttcatgacagatactgatttgtagttcagttttatgtctttgttaattttctattattaattgctgagagtgaggtgttgaagtttctaagtataattgtagatatatgtatttctccttttaacgcagtaatttgtttttttttgtttgtttgtttgtttttgagacagagtctcgctctgtcacctaggctggagttcagtggcacaatcttggctcactgcaacctccgcctcctgggttcaagcaattgtctcagcctcctgagtagctgggattacaggcgtgcaccaccatgcccagctaatttttgtatttttagtagagacgagtttctgccatgttggccaggctggtctcgaactcctgacctcaggtgatccacccgcctcagcctcccaaagtgctgggattatagatgtgagccaccgcgcccagcctacacagtcatttttttttacttctgttttgaagctcttatttggtgcatccacgtttaggatggctatgtctttttagtggattgatctttttatcattatattatatccctcttcatttcttgtaattttctttcctgtgaagtcaactttatctgatattatgtactccctgctgctttttattgcttaatgtcaacatgatatatttttccatccttttactttcagcctatcctatgtttcaagtgagtttcttgtagaaagtgtatagttaatgtttatccatgttttttatcccttctgtcaatgtctcttaattggcatatttagactgttttgcattcaaagtaatttttgatatgctaggatttaagtctatcatgttagtatttgcattttgtttcttctctatgtttctccttcttatgcttctcttttcttacccacctgtgggttatttgaaattttttaggattccttcttggttttcttttgcttggtcatgaacttcttgttttatttatactgttttgagtatattatactgtacagttttcttagtggttgctctaaggtatccatacacacacacacacacacacacacacacacacacacacacacacacacacacacacatatgaacttataccctacagataccgacattttaccacctctagtaaaatattgaaatctgagttccatttagatctgtttaccactcccacttttttctgagccggagtctcactctctcgcccaggctggagtgcaatggtgcgatctcagctcactgcaacctccgcctcccaggttcaagcgattctcctgcctcagcctcccaagtagctgggattacagctgcctaccaccgcacctggctaatttttgtattattagtagagacgaggtttcaccatgttggccaggctggtttcaaactcctgacctcaagtgatcttccctgcctcggcctcccaaagtgctgggattacagacgtgagccactaggcccgaccttttttttttttttttttttatgtgacagggtcttgctttgtcacccaggctggagtgcagtggctcagtcatggtctactgtagcctcaacctcctgagctcaagcaatcctcctacctcagcctcacaagtagctgggactctaggcatgtactaccatgcccagccttttgttgtttttgttttcttgtagagatggagtcttgctatattgcccaggctggtctcaaactcctggcgtcaagcagtcctcctgcatcaacctcccaaagtgttgggattataggcattagccaccatcagctcccatcatctttgaacttatctgtacacaagaagatgttccagacctatcctattcttccttgccccagctttataatcagtcatctccagtgagctctggttgagagggtttgttttcatggagaaataatctcatttataggaagaatgatttaggaatgagggaaaatttcttgaaataggaaaaaaattaccgtagtgatgtccttgagaagatgagaggagatgacatttagtttctacatagaggggttggccttagcataggagtacagttgtccataataataagcgtgaaggtagagattatggccataaatgctatttaggtgggtggatgttatggaaattatctttttgttgccttttttattttctcagtgaaatggaagcaatgtcatcagctgagaatgaagttaggggagggagtgtgtattagaagtttaatgatggaagcaaaagtattaaatagttacatagaagaatggtagtagaatgaatgaacaagggaaatgtagtgagattgccaggcagcattaaggatcctcttgaagttaattaaagagttaatctctttgttgagtttggtgcttcttttttttctaagttttagtgtttctcaaggatttggtgattcttggttttttattcagtcatatttaagggtcctgttcacctgtctgatttgtttacttacagtagcctgccttgctgccagttactgtagaggagagacaagttgtgttgggagcacgttttcttagtagtttgttacctgtagatttgttcttcctctcaggctctaccttgagtttttgggcaaatttccttgctgctcactatttagcataatgaggggttaggagaggataggattgcctagcctagctgctgttaattcaccatatcatttaatctcccagatgaattccccaaagccaggcaatcttctggtatccattgagtagttttagagcttccccaaatcactcctaactttgcaatagttttctcctatatgtgcgtttgaagctttggtttccatatattttgttccccatggatgtgatctattggtttctgttcttttggaaggttctttaccatttatggtctgtggatggcattctttttagtttttctgggatgttatgactttattctagtttttgttttttgctttaagatgggagtctcgctctgttgcccaggctggagtgcagtggcacaatcttggctcactgcaacctccgccttccgggttcaagcaattcctggctaatttttgtatttttagtagagacagggtttcatcatgttggccaggctggtctcaaactgctgacctgtagtgatctacccgcctcggcctcccaaagtgctaggattacaggcgtgagccaccgtacccggccaattctaggtttttaaagtaataatttctgttgctttctagagtattaggtagttggtaagacagatgtatacgttcgttgttaccatattgattcagtcacagaatttctcttatctacatgaataatgtggattgacattaaaagggaaaataacttagtgattttgttgttgcaaatatctagcgttgacaactagaagcaggggtttcattcaggtttttgttgatattgttttcataagtactgactggattggccagatttcagactttgaatgcatgaggagtcattgaaaggttatgtattacttgttttcatggctaaatctacatattagcatagctgagttgtgtatttgtaagattactctagaaattgtggttctattttctattttactactattcatagcttagccaatggaatcatttgctttgttaattccagtttcttaatcagtgaaggtaatatctttatacttcagtctttatcttaattctagccatggtatgttttagacccatatagttactgtggttatcagtggttttaagaaattggctttgtttctggtgacatttctattcttttagtgcttacaaaacagtacagaaactatatgaagaatggactctgttgatgtgtataacactgacattaattggcaaaagattctctacgttcagtttgttcagaaatatccatgggcctactgtgagtgaatattattaaaacactccacacctgtattctggtaatgaccattttattatgtaaccagtttctgagactagctggctgccttccttacttccttcctccctcccttcttcccaccctcttttttcatccttttttttttcttttgagatacggtttcactctgtcacctagtgcagtggcactatcatagcttattgcagcctcgaactcctgggcttaagtgatcctgctgcctcagcctcccaggtagctgagtctgaggcattctaatggagtgaaacttatagttagggagttgacattttttgaggacctgctatgtatcaagcagtgtcatttcgtttaatcttcactgtagcttcctctataaagtagttaattccattacatggaaatatttgtgtaaaaatcgagaaagttataactgatttctctagagagatattctagtttccagggaatcagactatttctgtaaaaatgctatttagcacagtattgtatttatgtgaaattgctttattctaattgaagggaaatcagtttaaacagtgggtgtgtttgctgaacattgtcaaaaagtgttcccaaaaggcatgtattgctttgtatctattcatattgttgaaactggtaataataaggacattagtcatttggattgatttccagtgacattattcagccctctcccttttgtaatgtaaatcagttagaatactgaagatgttgaagtggggagaacctttcagattgatctcatttttccaggaaggagccagcttcgtaaatagcagcacagttgaactcttcaatttgggaggttggttgaatgagctaaaagactgattatttgcggattaccatgataaggtatttaagaaaaaggcaaactgttgttttgggaggatagcaattatgaaagctttttaaaataattttatcatattatacatgttatattcttgatttatatgtgtacattcaattttgaaactacaattctaacaatttggactcaatattaactattggttttagtatagatcaccagtttttataccacatattctctattcttgatttttaaattttgctaagtacctgtgtagtttgaagaatggctttgtgtaatttttcaaagttacttgggtttgaaatttctgattctttggatatccgaaactgacgtttcatttacattcacacatgaacaaaaacttgttaggcattaaaaaaaaatcagtttacagtctttttttcccatctacatattttgttcttttgtcttcttctagctaatgcttcagaagagaagcctaggcctgtctgattttttttgttcccttttcctcctaagtgcttataggtggtattctttatctttataagtaaaaagtttggtatatatatttttttaattttcagaattctttgggtatggcatacatcttttatatgtcttggtatggatcttttatttcctcacataaaaatagctttttaggctgggcgcagtggctcacgcctgtaatcccagcactttgggaggccaaggcgggcagatcacctgaggtcaggagttcaagaccagcctggccaacatggtgaaactgtgtctctactaaaaatacaaaaaaattagccaggcgtgcagccataaaaaagaatgagttcatatcctttgcagggacatggatgaaactggaagctattattctcagcaaactaacacaggaacagaacaccaaacaccgcatgttctcactcataagtgggagctgaacaatgagaacacatggacacagggaggggaacatcacacaccgggcctgttgaggggtcgggggaaaggggagggagagcattaggacaaatacctaatgcatgcggagcttaaaacctagatgacgggttgataggtgcagcaaagcaccatggtacatgtatacctacgtaacaaacctgcacgttctgtacatgtatcccagaacttaaaattaaaaaaaaaaaattagccaggtgtggtggcaggtgcctgtaatcccagctacttgggagggtgaggcaggagaatcgcttgaacccagtggtggaagttgcattgaaccaagaccacgccattgcactccagcctgggcaacaagaaagaaactctgtctcaaagaaaaaaaaaaaaaaaaaagaggccgggcgctgtggctcacgcctgtaatctcagtactttgggaggccgaggtgggcctgaggtcgggagttcaagaccagcctgaccaacgtggagaaaccccatctctactaaaaatacaaaattagctgggcgtggtggtgcatgcctgtagtcctacctacacaggaggctgaggcaggataatcgcttgaacctgggaggcggaggttgcagggagccgggatcacgctgttgcactcgagcctgggcaagaagagcaaaactccatctcacacagacacaaaaaaggagctttttaaaaataacttttcttctcataaatactttttaaagtacagaaatgtataaagaaagttaaagttacctatgatcctacctctcaaaaacaaaacttttgtagtttttctagacattttccatgctatgtgtgtatgaaaaatgtgtggtattttatcagaattgaatcataccagctgttcttcaaatttttttttacaaaggtatatacattcattaaggtatcctaaatgtacagtttgatgagtgttcatatatatatatcttcatgaaatgcaaatgaagatatagaacacttccagccccctagaaagttcaccgagattcatctacattgttgcatgtatcaatagtttgtttcattgctggtagttgttctgttgtagaatatatcatgattcagttatccattctcctatccatgtacattaggattggttctagtttttggctcttatggataaagctgctgtgagctttcctgtatattttttggtgaatatatgcactcatttctcttgtgtatatacttaggaatgggattgttaggtcacagaataagggtagttttagccataccttatattgccagacagttttccaaagctattgtactgaaatacgttcccgctggcaatgtatgagacttccatttactctgcatccttatctgttgtcagttgtttaaattttagctgttttgatgagtttgatgtggttatatattgtggtttttaacttgcattttcctgataaataatgatgttgagtgttttttcatataattattagagattcaaataccttctttggtgaagtgcctattcaaatcttttaatttttgtatttagtctgttttaattttgagcgattcttcaacctttttctgtctttcttgacagtattgcaatgcagaggccagttgtttttttttatagaatgtctctcagtttgggtttgtttgaagtttcctcatgattatattcagataatgcattcttggcaggaatactgtgtgagtgatgttgtcttcttatcagtgcatcataatagaagtaatgccagtttgtcccaatattggtgaagttaacttttattacttggttcaagtggggcctgccaagcttctctactgtaaagttatcgtttcttcccttatagtttatgagttatttgtggggagatattttgaagctatgtaaatatccctttcacttactagttttagcatccatttatgattttctagctccatcattcctctttattagttggccattctccctcatttatttatttatttatgttagtatgaactcatggggaccttattttatttactaggttatagtataatactatcattatttatttagatggttaaaatgccctagatttgggggaccattcatggtagcatttgtgtccttttgacattttcccatcattctttgaacacttccttattttctggccacagcaagacagatattccaggctcattttgtcttttccctgcccctaccctggaatccagctatttctccatggagttctgattcctttaatttattgatttatttgcatttttaaaaatttttttgaggcagggtcttgctctgtcactcaaggtggagtgccagtggcaagatcatggctcactgcagcctcaacctggctcctgggctcaaataatcctcccatctcagcctcccaaatagctgggactatatgcatgtgccaccacggccagttaatttttttagtttttattttttgtagaggcgaggtattgctcagttgcccaggctggtcatcaactcctgggctcaagcgatcccctcgcctcagcctcccccttattccttttagtgggtaatgtaatttagaaaaaaagcctgagtattgggtgtgtttgctgctactggggagttattgcttctagagttctcagcagacaggctaggaagtgtgtgtgtgtgtgtgtgtgtgtgtgtgtgtgtgtgtgtgtgtgtgcacgcattcagatatcttaggtgactttgcttttgactttgtgttctaggagagaatttatatattttttgccatgtatctccagtgtacatgcaagatctccacttggttgtataatgacgtttcaaattaagtatatccaaaatcgaacacttacatttgcactttccaccaccccaagcctgctcttttcactgtcatccccatctcaacaaatagcaactctgtctttccttactcaagccatatggctatggtttttttgttgttgttgttgctctttttttgagagagtctcgctctgttacccaagctggagtgcagtggtgctgtcttggctcactgcaacctccgcctcccgggttcaagtgattctcttgcctcagcctcccaagtagctgggattacaggcacttacaggcacacaccaccatgcccgcctaatttttgtatttttagtagagatggggtttcaccatgttggccaggctggtctcgaactcctgacttcaagtgatccccccacctcggcctcccaaagtgctgggattataggtgtgagccaccacactcagttagctatggtcatcttttattctttgctttctctcatattccacttcaaactatcagcatgtcttttgactctttttacaaatttttgtgggtaaatagcaggtgcatatatttatgggggacatgagatattttaggcctggggatggtggctctcccctgtaatcccagcactttgggaggccaaggcaggaggatcacttgagccgagaagtttgacaccagccaaggcaacatggcgaaatcctgtctctaccaaaaagaaaaaattcttttttatggcttcatagtttcctatggtgtatacatgccacattttctttatccagtctatcattgatgagcatttgggttggttccaagtctttgctattgtaaatagtgctgcagtaaacatacgtgtgcatgtgtcttcatagtagaatgatttataatccttttggtagatacccacatgtatgaagctggaaaccatcatcctcaacaaactaacacgggaacagaaagccaaacactgcatgttctcactcataagtgggagttgaacaatgagaacacatggacacagggaggggaacatcacacaccgggacctgtcgggggatgtggggaaaggggagggagagcattaggacaaatacctaatgcatgcggagcttaaaacctagatgacaggttgataggtgcagcaaaccaccatggcacatgtatacctatgtaacaaacctgcacgttcagcacatgtatcccagaacataaagtaaataaaattatatatatatatataaataaattaaaagttagctgggcatggtggcccatgcctgtagtctcagcgactcaggaggctgaagtgggagtattgcttgagcctgagagatcaaggctgcagtgagtcttaatcacattattgcacttcagcctggctgacagagcaagaccttgtctcaaaagaataaaaagagatattttgatacaggcatacaatgcataataatcacatcagggtaaatggggtatctatcacctcaagcatttatcctttgtgttacaatctaattatactcttaattatttttaatgtacaattaaattatcaactatagttgacttgtgctattaaatactagatcttattcagtttttctgattaatttttgtacccattaaccttccccactcccctcctgactctccccactacccttcccagcctctggtaaccatccttctactttctatctctatgagttcaattgttataatttttagctcccacacataagtgagaacatgccaagttcatctttctgtgcctggcttattgttcacttcatataatgacctccagttccatctatgacaatatctcattcttgtttattgctgcatagtgctctgttgtgtatatttgatttgactcttactttaacatatatctgcatcctgacttctcaacaccttcaccattgtcgtgctggtctaattcagctctttttttttttcgctgtcttgtccaggctggagtgcagtggcacgatctcggctcgctgcagcctctgcctcccaggtagctgggagtacaggcacccgccaccacatctggctactttttgtatttttggtagagaccaggtttcaccatgttggccaggcaggtctcgaactcctcacctcaagtgatctgcctgccttggccttccaaagtgttgggattactggcgtgagccactgtgcccagcctcatctcttgaataattgtagtagtctcctaattgttcttgcttttgcttttgttcttttgtagcctttttcttattgtaggaagcagtgatagttttaaaatgcaggtcacaacatgtctcagagacccacaacctctcgttgctcatctctttgatagtaaaagccacaataatgtactaatggcctgcaaagtcctacaggatctggactcccctgcacaactctctgacctcatgtagattttctttgacttccgttttcctcttttttttcagacggagtctcgctctgtcacccaggctggagtgcagttgcgcaatctcggctcactgcaacctctgcctcccaggttcaagcgattctcctgcctcagcctcccaagtagctggaattacaggcacatgccaccacgcccggctaatttttgtactttcactagagacggggttttaccatattggctaggctagtcttgaactcctcacctcaaatgattcgcctgcctcagcctcccaaagtgttggcattacaggcatgagccacccacaccccgccccattttcctcttgaatgatgattaaaccctttcataggcctatagcttgaggacaaggagatgcacactttctgtgtattagtaagcattgatttattctggttcttctgtactgaagtgtggtttactttttttactcccataatgaattatccaatgttctgaaataatcaaatactttaaagactatgatctccaacatgcagggctgccaaaatgtgtctgcatccttgctcatttggctttacttataagatctctaccttccagactgcgaaatggctcagtctgtcctctccttttcttctccagtatgcattctcattcttgccattaaaaaaaaaaaaaatgttagttgctctttccaaatatctgtagaaagctttgcagggctgaggcaagactgtgcctgatcagtttgttagttcttacagacctttgatcacttaacggggcagtattagaataaaagtttggaatttaagtctgctttcatgaagttaggctcccctcaattcagttctatctgccttacagttaatggaacttcttcctagttcctatcactctttcatctctcatagttcctatcactcttttatgtgtcagtctttgtagtgctggtatgttttcatcattttggcctatgtaataggctggatgtcattatgtgagttttatcccaggaaccgtgcttttggatcagttttttaacttagggtaaatttcatcgttcaggcctggcacggtggctcgtacctgtaatcccagcactctggaaggtcaaggcaggaggattgcttgggcccaggagttcgagaccaacctgggcaacacactgacacccccatgtctaccaattttttttttttgagacagtctcactctgtcacccaggctggagtgcagtggcacaatcatggctcactgcaacctccacctcccgggttcaaacaattcccgtgcctcagcctcccaagtaactgggattacagtcatgtgccaccacatctggctaatttttgtatttttagtacagacagggcttcaccctgttggccaggctggtctccaactcctgacctcaggtgatccgcctgcctcagcctcccaaagtgctggattataggcatgagccaccacacctggcccaaattttttttaaaaaaattagccaggtgtggtggcacatgcctgtagtctcagctgctcaggaggctgaactgggagaatcactttgagcctgggaggttggggctgtactccagtctgggcaacagagtgagaccctgtctcaaaaaaaaaatgtttagaatcttgccttcaccaacaattggccttatacaagacaacgtctttatagatgaagaattctatataaatataaaaatatggaagtgggcatcatgcacagtgataattttatttaattaaataagcaaaaattccactgttaaccaggtatatacagcatacatataggcttgagccaatttgtgtcattggtcagacctggatttcaactctggctctttgaactcactgtgtgacttgaggaaagttatttaatctcgcccagctttggttctttttagtgtgaaatggttttaaatggttgtaaaagttttaaaatgcctatcttgcatttgcaacctactttgaaatatatgggataatgtacatatagtaaaatcctgtagactatgggtggtgttagatatataggttttcacagaacaattccacttttctatgtgttggaaaatttttataatgttagaaaaaatgcctgtattgcaggcttattaggattaggtgatataaaatatgagaagtgtctggcatgtaataggtactcaacaaatagtggttgttaaaagtacttcaggggagagatatgctttgtaacatcaataacataataaagcaatttatgaaatgtttaaaagtacatcccagttttactggtctccttcactccataataactgaataagaatctctgggatgttgtacatgggcttagctttttatctcttttgtcctcccatctccccttctggggctgagaaccactaatgggaggaggagaggagtggtggagcaagtaaaggagaaagatcctcctcaacaccttcccgaggtttggcattacataagacctcagaaccagttaggggagcctcaagaatataaccaagattgattccctgctcctgccccagcagaagtagctgtatctacttttcttttcttttttttttttttttttgagacagtttcactcttgtcacccaggctagagtgcaatggctcaatctcagctcactggaacctccacctcccaggttcaagcagttctcttgcctcagcctcctgagtagctgggactacaggtgcatgccaccacacccagctaatttttgtatttttagtagagatgggatttctccatattggtcaggctggtctcaaacttctgacctcagcctcccaaagtgcagcctcccaatgtgagccactgcgcccagcccactctttattatatatgtttaatgtttgactccagggactccatcagattcattttgtatcctcactgcctcttagcacagtgcctgctacacactaggtttccaataaatgtgtgaaggtagaaataagaaaggaaagggtgacataggaagaaaaactgtgccataaaaatgttcatgatctgatattgccaatcctggaaataaatctgaagaaaataataaaaaggaagcaaaaagcacatactacaacgcttgtttcatagtgaatgttagctatctctgtatttttgctgtatttttatttatatgtaataaaattggcagtaagttagttatccaggaataggggaggagttagataaatatgaatacttattgtcctatcatgtgcccattaaaaactgaagtaatgcaggccaataaaggtaaggaaaaatacttaatacattttaaaaagcagaaaaaactgtataattacaaccatttatacacatgacaaaagcctatagtattgaaacaaatattataatcacagccatgttaggaaaacagcattctaggtgatttttcccattttcctacattttataatgttatatacatttaataattaaacatttttataggatagcaaataccaaatgtagaggaaaatggatactttcacaaacctctggtaggactgtaaactggttagacctttctgaagggcaatttggcaatatatatcaagccttaaaaatgtctagcaattccatttttagaaaggcttcctaaggaaataattaagaatgcatacaaagatttggctacaagaatgttcctcacaatatgaaatatagttgcaaatagcaaaaaaattagatgtttgtctcccttacttgcaccattaaataaataatggtatgtttacactaaaggatattatgtagcccttaacatgttcttaaacacttaagatgttttcagtaaaaagaagattataaaagagtacatacattatgattacattaaaaacgtgtgtgtgtgtgtgtgtttgtgtacagaaaatggtctcaaagaatatacaccaaggtgttaaacaagcttatctatattcatcttgctttggtaataagaaaaaaataaattcaactttgtacaaacagacttaccaagcctcaaatctgataatcttagggtaggtcatcattatatcaatatgcaacactatagtacaatcgtcctttggtatctgtaggggattggttccaggacttttcttggataccaaaatccaaggatgctaagccctacagttggccctgtggaatcacacacatgaagtcagccctccatatccaagggttctgaatcctgaaaatactgtcctgtcttgtcttgtctttttctttttcttttttttaagacagggtcccaggttggactgcagtggtgtaatcataggtcactgtaacttcaaactcctgggctcaagcattcctcttgccttggcttcccaaagtgctgggattacaggtgtgagccaccatgcccaggcagaatattacattttcaatccaagattggatgaacccatgcatgtggaatccacagataaaagggctggctgcagttttaaacaaaagtgaaaatgggccaggcgtggtggctcacggctgtaatcctagcactttgggaggccaaggcaggtggatcacttgaagtcaggagttcgagaccagcctggccaacatggtgaaaccccatctctactaaaaatacaaaaaaaaaaaaaatagccgggtgtggtggtacgcgcctgtagtgccagctactcgggggctcagacaggagaatcacttgaacctaggaggtggaggttgcagtgagccaagatcacgccactgcactccagcctgggtgacagagcgagactccatctcaaaacaaaaaacaaacaaatgaaagtaaaaatgaaacatttcattaaatttgaaagacatctgcaaaaatggcccagcacctatttgtaaatattaattttgaaacctttagaaatattatgacagagcttaacttgtacctatcagatatgaaggcagataaaccaaacattagccatgattctgagcaccagcacaaagtagcattaataaccccattaataattgcaagtgattataaaatatatttccatattattgtatagtagctatgttttgtttctctttgattagtacatacacttgtctctggatttatgcattaggatgccagttgctgttccaacttacggggactgtacaaacattagttaaattagatacattttgttgaatcttaagtgtacaaaaacactatttgccgaaatatttgctctcaatgtttaaacagtaattatgttaaagagctaattaactaatctataattagaagctagtctaatttatgcaggaaaaaatttctcagtatgggttgattagaatgatgaaatagtttgaaatagtttagggaagtggaggaatataagtagagtcacaatatgcagaagagcctaatttatacagaggagctacagtttagcgtggcttcaaacagagagataaggctagataatcaggtataggccagttcattgagaacattatttgccatctgaaggaccttaatcttatagaagatgaggcaccatcatatagggtttaaactgggtaaggaaattatcagttttgttagatttgcattctaagatcactctgctatcactagtggcagtgcatagaggatggattaggtaaatgtaaaattattttccagtagaattggtatttgccctattaagagcttaaacacttttctcctggaagccaatgttgcagctgctgagtactaattccttgaagggatagttgaaatagtctagagaaaagagatgagagacagacagacagactacacaataagttaatgcttgagtcattgatttatcttcttgtagaatggtagtacctcttcttttaagtagtagtcttacaactaggactggaagctcgatagtagtgtcttccattgaaaaataactcaaaacaaaagtacatataacagtaataactttttcaaatgaaaaatcttcatgtataagatgtacttgttgtattgttaaattttatttatctttggtaataatgttaataataggattgatacagacattcaataacatagatattctaccaggtttgcaaggtaaccaaaactatcgtgttttctgaatagtaacaaattgtatatttagcttgaattttactgttatcatagcaagttttatgtctgtactgtttacagcctgtatcccaaccagttggagctgaacaacaagcagctcttctaaaaccagatttagttcgaaggtaagtatcttcaaattaataccatgagaacaatgaggatatgctgaagtttgtttactcattaggtgcttagtgcatcctgactagagaagcttctgtattcttgtacttgtgtggatgtttaataaagacgatagtttttttttttttttttgcttttttatgtcagtagggatcatatggattgtgaaattaattgatcattttcttattgtgtttatttataccattctgttctaggaaaagctggtaagggttaaggaaggaagaaacaatagagtttagagtagaattctagctaatctaaagaaataaattacaactagatatttaattgtattattatttagtacttgaaaactagtatttttctgtataaaaatatagattggatagtctttattgttctttcttcaagttcattgattgtttcctttgtcctgttcattctactattatgcctattcagtgaggtgtttttttttttctgtgattgtttatttctatactttctatgtggttcttcttaaaatcttctatttcttttataagattttggttttttttcatttgcctcaagattatttgtgattgctcattgaagcattttgatgatagctgctctaaaattattgttagaggccgggtgcagtggctcacacctgtaatcctagcactttgggaggctgaggcaggcagatcacttgaggtgaggagttcaagacctgcctggcaaacatggtgaaaccctgcctctactaaaaatacaaaatttagccaggtgtggtgatgtacgcctgtaatcccagctacttgggaggctggggctgggggattgcttgaatccaggaggcagaggttgcagtgagctgacatcgcaccactgtattccagcctgggtgacaaagtgagactctgtctaaataaataaataaaattcttgttagataattccaatatctgattcatcttgttcttttttttttttttttttttgagatggagtctcactctattgcccaggctggagtgcagtggcacgatttcggctcactgcaacctccacctcctgggttccagtgattcttgtgcctcagcctcccaagtagctgggattacaggctcgcaccaccacgcctggctaatttttgtatttttagtagagacagggtttcaccatgttggccaggctggtctcaaactcctgagctcaaatgatctgcccgcctcggcctcccagagtgctgggattataggcgtgcaccacagcgcccagcctcatcttattcttgttagatgatttcaataactgacttatcttggtgttggcatctgttgattacctttttgcattcaagttgtaatttttctagtttttggtatgacaaaggagtttattttcatttgtctcctgggcgtttggatattgtcaggtgactgtagatcctatttaagtctttttttttttttttttttttttttttgaggcagagtcttactctgttgcccaggctggaatgcaatggcgtgatcttggctcactgcagcctccacctcctgggttcaagcgattctcctgcctcagactcctgagtagctgggattacaggcacatggcaccatgcctagctaacttattttagtagagacagggtttcaccatgttgtccaggctggtctcaaactcttgacctcaggtgatccgcccacctcagcctctcaaagtgctgggattacaggcgtgagccaccatgcctggcctattgaaatcttctatgttagcaagcagtcgcccttgtttagatgcataggttctggcctgcttttgtgggccgtgattctgatgacaatttagttttcaaaatccttacagtgctgctattctggtttgttttgttcacctgaacccctggcccccactgctgggccaagaggtggagagtgcttccctaggcctgctcccccaggtgtgctctacaggctatactctacttactggtggggctcctaccagcggcactggggaaggacagggcctacttaagtcctcttctgttgctgggttggggatcaggagatactgtgcttgggctgcctttgcctctggactgggaattgggagacactgcctgtactgcctttattcactgggtggataattggaagataccaagctgctatgatgttactcaagtcctaggggtccccagccagtccgctttcatcttttcactcttctgtgccctcctgtcattgtctactacattatttctagaacttttagctgtacttagaggggaggagcagggagagttgagtttctgccatcttgtcccaaaccctaaactgatgtgttaagtaactttggaatgtgaatgatatagcccattggctaaaattatattccttttatcctctgattacttgttactgccatttctctgtgtatttaaaaaactcttaagggcagtattaatgtatcttcttccactacttatatttatgtcatacgtcatatggacataaaaaatttaggagttatttttatctcttgtacatctatatatagatgcttcatgagtagtttttaggagaaataacttgcttaaattaacttgaaagatatctatttcaaaaagatgtctgagacttagagcttgtcatttaaattccaaacgtgtttattgaaatttttgtatttgttgaaatatgtttgagtttaaagaaaaacctgaaaaatgcctttgacgcagataaactaaaaggtagcctcccctttcataataatattgatgtagacctgtaaaatgtaactaattagaattaataatgttgagctatttttacatcattcattttcatatcttgttctgcctcctgcagaacactattcttgtctcccatacctggtctaccctgttgagttcattacataaacaagtatattttgagtgataatttgttttggttttagaagttttgtttgaagatattaataaagtaaccaaacaaacaagataaaactgatcaagagcaccctataataaaaggctccacagaggtctatcactggcaatatttttctttcattctcatcactgtgagatggtttgctaaatgctaaataaatacagtgtgaccttgatttttcagctttttaagaaagctttattgaaatataattcacataccatataattcactcatttaaagtgtgtaatttaatggcttttagtatattcacagagttgtgcagtcataacttttaaaaagattgtagtattaatttttcttaaattcattatttatagttttataattgggagtttttcttagaattttactgtcaagactggaatgagttacttttttaaaaatattactagcttgaatcaagatgtggcaactacgaaggaaaacgtcagtagccctgataacccaagtggaaatggcaaacaggatcggatcaaacagagaagagcttcctgtccccgaccagagaaggggactaaatttcagcttaccgtccttcaggtcagtttgtaaatatggtttggttaagagtacatatagaggtctggagggtcagagaggggcagtgctgcagaagtgagttgtagaatattgcgagaccctctctaaactaaccttttctccgttacagactttccaatgtgagtattatgtgttcgttgttaaacttaggaaatataagaaagaaaataaaatctacttttaaccaccattcagagatagctcctattaatgttttagtttgtttttctctccttttcctgtatgtacatgtagtgttttacattattgaggttgtaatagtactagtaatcgcagcaaaaatctattgagttcttttgtggtaggcaccctaaatgttatccatgcattttaccatttaatccttcaataaccctgtatgataggtcatagtatatactcatctttacaaatgaagatactaaagatcagaggagtgagccgggcgcagtggctcacgcctgtaatcccaacactttggaaggccgaggcaggtggatcatctgaggtcaggagttcgagaccagcctgaccaatatgataaaaccccgtctctattaaaaatacaaaaattagccaggcatggtggtgcatgcctgtaatcccaactactcgggaggctgagacaggagaatcgcttgaacccaggaggcggaggttgcggtgaactgagatcacaccattgcactccaacctgggcaacaagaacaaaactccatctgaaaaaaaaatgaaatcagaggagcgaagtaagttgcctaagatcactcaactagcaagtgataatgtcagatctgaacctagatcggactttaaagcccgtatctctaaccaatataatgtatgttttagttggctgcttaaacctatatataattttatatcctgcatttttaaaaacctaatatatcatgtatgccttcctgtatcattaatttttcaataacatgacattttaaatggctacattagatagctgcttatacagagaaataacttacattccctatgttcttggtttatgttctttctttccatctttttcccagtctgtcttttttctaacttgctgtcttttactctttttgtctgtctgtatatctttgcagcaaaatccttgaacataaatctttgtatctatccctgattatttccttattagatccataggagacggattcatggatcagaatatgaagatttttaaagtttctagatacatgttgctagattgctgtccataaagattggtccaggttacatttccatttgcagtgcctcttcttttgcttagagtcaatttatagattaagataattttggaaatgaattattaaatttaaatctttgcattgcagatagctctagtgactattataactttttttgctttcttataaaagttgtattgttttctttaccacaggatcacatttataacttattttttactgagtaacttgaacctgttagtttagtcatagaatggctgtttagatggtattccaccaagggaaaacattctgaactatttaagccattttccacatatattgtacgtgaactagtgtagatgttccttgcacaatttgcaaaaagaagacagtgattgactcttaaaccggtaaaatgtttgtactcaggtatcaacctctggagataacatggtagagtgtcagctggagacacacaacaacaagatggtcaccttcaagtttgatgttgatggtgatgcgccagaggatattgcagactatatggtaagtgcagtaagaccaaattatcttcccttcagcattctgtcttttttcccctataattctgtctccatttattttgagccattgttttttagagtacgattagttttaaaattttgtacagaggtaaattgggttatcatcaagtgtaagtcactgcatctcctccggtttcagtatatttaactggaaaatatgcagaggtttcatttagagataatatagctaaatggctcttatctctgattgcatgtgaaaatcacctgacaagctttttaaaaacaattgtattgcctggtcccttgattaaatcagaatatttggaggtgaggcccaagcatcaatagtttgtaaagctccccaggtaattcttttttttttagtttattttttgctgggcacagtggctcatgcctgtaatccccgcactttgggaggcctaggcaggaggatcacttgagcccaggagttcaagaccagcctaggcaatgtagtgagtgagaccttgtcttcacaaaaaattaaaaaatgccagatgtggtggccacacttgtaatcccagcactttgggaggctgagggaggaggattgcttgagcccaggagattgaggctgtagtgagctatgatcatgccactgcattccagcctgggcagcagagcaagaccctgtctcaaaaaaaagttaccttttattatttttattttttataacaggctttgaaaaagctaaagccccaggtaattctttttctttctgtttttttttttttaatttttgtggctacatagaaagtttatatatttatgaggtacatgagatatttcgatgtaggtatacaatgtgtaagaatgatgtaaaggtaaatggggtatccctccccttgtaattctaatgtgttagtcactgatctaacatcttgcatgttattgtttcatttagtttttaatattttctttgaattgttaggtttaagttagtatttcttccccccttattttattatttttttttattattttctaggttacttttccatcttccccttttttgatggggatgggactaggatggcaggaagagtgcatataatgctttttgtttctgccagctttctttgtgtatgcatttctagccaagcagaattaaacattttaaaagttaattatttcatcatcagttctgttcttgtttaacgtaatattttctgaactgtctcttctttcattcttttcaggaatgtttaacctaattagtggtcttccgagctattttttttttttttttttgagacagagtctcgctctattgcccaggctggagggcagtggtgtgatcttggctcactgcaacctccgcctcctgggatcaagtgattatcctgtctcagcctcccaagtagctgggattacaggcgcacgccaccacacccagctaatttttgtatttttaacagagatggcatttcgccatgttgaccaggctggtctcgaactcctgacctcaggtgattcacccacttcagcctcccaaagtgctgggctaccgtgcccagccttccgagctattctttattttctttggagatgtttcattttgtggtttgtgatttaaaagcttttgggtttggacatcttagttttaaacattgcctcagttatgttcttcaaataaccaatttatagaatgacatattttttaaaatgctggttccttctctggtaggtagtgccaatctgagaaatgtcagtagtctcagaataatttaatgtattttttggcattttattgctggtctttgtgaattctattgtgacacttggatttagatacttaattttaattttattcttctttttctttttcttttcttttctttttttttttttttttgagacagagttttgctcttgttgcccaggctgtagtgcaatggtgcaatctcagctcaccataacctccgcctcctgggctcaagcaattctcctgcctcagcctcccaagtagctgggattacaggcacccgccatcatacccagttaattttgtatttttagtagagacagggtttcaccatgttggtcaggctggtctcaaattcctgacctcaggtgatccacccacctcagcctcccaaagtgctgggattacaggcatgagccactgtgcctggcccaattttctttctttatgtgatagtcactatttatataatattataactttgaagaaactgaattcattctcatgaatagacttacttttgggcaggttgaagataactttgtgctggaaagtgagaaagaaaaatttgtagaagaattgagagctattgtaggtcaagcccaggagatccttcatgtccactttgccacagaaagagccactggagttgattctattactgtggactccaacagtagccaggtgagaacaattgtttagcaaacagatcttctcagatatgaatcaggaactttttaatttatctattcatttttaattcagacagggtcatctgaacaagtacagataaattctacatctactcaaaccagcagtaagtatatttagtaaaatttatcatttggtttttgaagcaagacatttgaaaacttttaacacaccttcattgggaaagatgttagccaataaattaatttggtaacttattagtgtaggttttctcacactttgaaaggcccaaaggtaataatccatcccctgacttttccccaagtgttggttctttatctgattgatttatttttgagttattgggtggtcatgttaccagaaaagcagtcacagtactgatgaccttaaatggcataactgtttgaaacttaactggtaagttatttttttctgatttgagatggatagaaactttttaacaaaagtcatcattttctaagtttgcctcatatttcaatagtcattcgtatcttgattttattctactaacgatgaatgatatgcttctacttgcgctggtcactgataacttttagtaaatcagataccagataaacttccagaagcgaaaactagggtctcctgttttcttttctgatgactttatctttccattcttctcagttctggtcatgggtatattaaagagtgtctgggagggggataagagccatagacaaatgagcacccctgaagaaattacaggaacgtaaagaagcaaaaggtggtgtgggagtaatagaaccagataccattatcctgaaatttagtttgactgtgttaggatgcagtccttcctatatcttatttttctggttagccaagatatgagtaggtttctgactaacaaagttgggtagagtttaaaagagaattacttatttgagtacatttacaaagtagcagttaagatgtaggggtttattttactttattttaaaaaatgtcatacagtaaaactgattttcttttggtgtacacttctgtaaattttaatacatgtatagatttatataagcactatcataatcaggatacagaataagagatataggttttaatgagaaaagtgctgtcagttttttcaaagagtaccctgtttctaattgctattcaagcaatatttgtttcagtagaatctaaaatccttctctaaagatattgtgtgcttagtactttagactttttgtcagtattaaaagggctggtcttatcaattacatatattctagtactattagaaatggagatataagacaaattgtttatttaacctggcttcttcagtcaataaggtaaataaattgaaaatagcttagcatattattttttgctaattatttctgcagatgaatctgctcctcagtcatccccagttggtcggtggcgattctgtatcaatcagacgataagaaaccgtgagactcagtctcctccttctcttcagcattccatgtctgcggttcctggccgacatccacttcctagtaagcttttcttctctgccagctttgtccagactcaaaggatgggatgcaaaatacatatgatatctttaactggtttccatgggaattttatgcttatgagaattttcataagcttttttgaagacattaatattaggatacaacttaagccatttcctatttaatatttatgagaaaaaaggaaaacattatttcccttgacaggttgaattctgtgttttgagtcttatttacgagagtactttcacacaggttctcatttgcccctttgtcctcctgttccttttgacttagggtactagtctgtgctttgtactcgtcagtacgtgcttagccattctttattattgttccaggtccaaaaaacacaagtaataaggaaatatcacgggacacattgctcactatagaaaataatccatgccaccgtgcacttttcacctccaaatcagaacacaaggatgtggttgatggtaagatttctgaatgtgctagtgtagaaaccaagcagccagctatactttatcaagtggaagataacaggcagataatggcaccagttactaatagttccagttactctactacttcagttcgtgcagttccagctgaatgtgagggactcaccaaacaagcaagcatattcatacctgtgtatccatgtcaccaaactgccagtcaggctgatgcacttatgtcccatcctggcgaatcaactcagacttctggtaactctcttacaactctggcatttgatcaaaagcctcaaaccttatcagtacagcagccagctatggatgcagagtttatttctcaagaaggagaaactacagtgaacactgaagcaagttctcctaagacagtcattcccactcagacccctggccttgaaccaactacccttcaacccactactgtcctggaatcagatggagaaagacctccaaaactggagtttgcagacaaccgaattaaaactctggatgaaaaattaagaaacttgctctatcaggagcacagcatctctagcatctatcccgagagtcagaaggatacccaaagcatagactctccattttcttcctctgctgaagataccctctcctgtccagtgacagaagtcatagccatcagtcactgtggaattaaagatagccctgtacaatcccctaatttccaacagacaggctctaagcttctgtccaatgtggctgcaagtcagcctgctaatatatcagtgttcaaaagggacctgaatgtgataacttctgtacccagcgaattgtgtttacatgtaagtatcattctttctaaccaattccttactctttgcttattgttttaaagaaatgccttctcttctaaaattctgtcctttgagatgaaatggtctatgtcacaagatgctgaggtcacaggtatttaagaaggctatgacttaggctgcaggtgttcagaacctctcagtagagatgacaaactatctttggtaagagagccctctggtgaattagctaagaacttgcaagcagtgtctatatttgtattaatgacagaatgaaaactgactcatggattgttttagtgggtaggaagaacttttagattttcacttaaaatgccagttatccgtttccttctttaaaaaaaaaagttatggtttttaatttaatcatgtttggggggatttaatttgacaaaaaaagagaagaaaagaaagtaaaaatcatcattaataccatgacttttttttttttttaaaccctagacggagtcttgctctgtcgcccaggctggagtgcagtggcatgatctcggtctgcctcccgggttcaagtaattctcctgcctcagcctcctgagtagctgggattacaggcacgtgccaccacgcccggctaattgttgtattagtagagacggggttttaccatgttggccaggctggtctcgaactcttgacctcgtgatccacctgccttggcctccaaagtgctgggattacaggcatgagccactgtgcctggcctgacttattttatgagttatataatgtaggaactttaattttccttttctgccccttcaaatcacaaaagtaaccactaataatttgatgcttattcttcttgacttttcttaagcttatacagatctatttacatacatataacattatattcataaaaatactgtgctgtatacatactgttctgcaacttaattttttcattttacagtagatcatggacatctttctaaatctttattgctgtatctttttgtcatttttgttattatataagtaataatatatacttgtacatagtatatatgtactacgtacaagtaaaatccaccccatccccaaacctgtagacacagctgttaacaaatctttccagacatgattttaattaatatacaaatatttataaagacatactttttatatatgatatattgtatctttatatagatatagatacatgttaatatttatatacatatacttatttacatatatgctattctgcatttttttcatttatgggtatctatccatgtcagtacacatagttccatcttactcaactttttgaaacaactgcataatattccactgatacatataatttaaagatttaaaaattttttaaattattttaaataataaatatcacataatgtgattcgaatcttaagaaatgaactgttatttctgtcatttaaactttgttgcttgaaggagactctcccaagtgtcaaggtcaaatgaattcatttatttgtttcaagtgtctgttgctatatctggatcatacttagctgccactgtttctggtgtcatggaattcttcttttttcccctaaaatacttctatgagtaatattttcaaatatattgcatgagtatcctatttggtattcttttgcatgtccaaaaatgtctttatattgcttcacacttgattgactaagtacagatggtaggatcagaattttttcttctcaatttagaagacagtgttttattgtcttttattagccttcctgatgagagtgatgtcagttgtttatcattcatttgtaggtaacctgtttttactctagaccactgcaatgctcttgtactttttacaacgtggaaatgttctgtatctgcactatccaatacagtaaccactaaccagatatgactattgagcacttgaaatgtgactagtgcaactgagggcctgaatttttaatttaatttaattaatttaaatttagacagccacatgtgattagtggctactgtattcagttagcacaggtctagttgctcttagggaactatcttagagctctgattatcagactgtatcttggtatatcactttcccattcattttgtatatcacttttgtggatgtttcgaatttgaagatttgtgtcttttttcagctccggtaactattttcatttcttttttttcttccccttcattgtcttgcttatttccatttagaaattgtaggagatatatggcctcttggattattccccatgtttcttaacagcttgctctcacttttaatttcattttttaaaaccttatgttctcagatatgtcttcagttttttttttctttttaaatttcagatcactctcttggtattcagctgtatccagttaatttttcatttggcagtcatgaatttgattttttaaatctttcttattcttggctccattttcatagcaacctatttttgcatatatttttgttccaagcttttttctcagaaaactgacaaaatattaactctaaaatatataaagaatgcttacaaatcattgagaaaagatcagacaactcagtggaagaatatccaaagcatctgaacgtgcatttcacagaagtggaaatataaatgcctgctaaacatgtgaaaagattttcaactttcttagtaatgagagaaaggcaaaattttatggaaaaatagttttttgctaatcagactagcaaatattaaagaaattgatggctgggcgcagtaattttcattttatgttggtaggaataaaatcagtacagcctacttggagggcaatttaacactatgaaagttagaaatgtgtacattcctgtgactgagctatgtcactgtcaaattctacctgagagaagtatttgcacatatgaacaaaggaacatgtataagaatgttcagtgtaacattgtttgattattggtaacaggaaaggattcacaaacaagtttaaatatttgtaaatagaaattgagggacactgatactatgaagcaatttaaaagcatgaagtagacctataaatatatgttagctattatcatctttattttagcatggacatatctccaggaaaaatcatcaggaaaaatatatgcagaataattcagacagtatgatgaggtgtgtgtatgtgtgtgtgtgtgtatatgtatgtatgtgtatgtgtgtgtgtgtttttgagacagggtctcactccattacccaggctggagtgcagtggcatgatcgtggctcactgtaacctcaacctcctgagtttaggtgatccccttgcctcagcctcccaagtagctgggactacaagtgcgtgctaccatgcttggctgatttttaaactttttgtagagacatgggcttgcagtgttgcccaggctggttttgaactcctggcctcaagcaatgctcctgccttggtctcccaaagcagtgggattacaggcatgagccaccacacctggcctgtatttttaaaaaggaacacacacacacacacacacacacacacacacacacacacacgcatatatatgtacataaatgcacaaaaaagttctgaaaagataaattgatattagtggatatcttccaggggagactgggaaggagggttgttacagggatttttgttttatctaatggtttagatcttttacagaaaacagttattcatgttataagccaaaaaatatctaaggcagatctcaatcaatttagaattttattttgccaaggttagggacatgcctagaagaaaggaaacatggaatcacagatacagtctgtggtctgtgcctttctccaaagatgattttgagggcttcagtatttaaaggagaaaagcaagctggaggggaaagagggaggttatggtaatccacatgttgcaagagaaaaggagcaggtaggagaataatcaattatgtattcatctcccaattttgctcagtaaatcagcactttacataagataaggtgaacatagggtagctacctctggagatatttaaccttttatttgtagctgtttgcttaggaacaaaatgaaatgcagtttcttgcatgactcagctttcagcttaatttttttctttttggcatagtgaattagggtcctgagtttttgttttcctttcacaatgtaatacttgtaatattttttaaatgaaaacattcttattgaaacagtgttagaaagaaaacagcttttgaaccccacaaaccagtttcaaaatcttgctttgccatttactatgtaatactaggcaaattatctacaccctttacccagccttaatttcctcatctgtaaaatcgagataatagtacctacttaaagggctactggatgcctttggtatattctctttattgtttattcatcttatttcatattctttgtgctctataaatatggaaacttgtcttgtgatttcttagaattttaactcttttacagtgttcgatccagtgacattaaatttgttcacaaggttgtgtatccatcaccattatctagttccagaactttttcatcaccccaaaaaaagaaacttcatacccattaagcagtcattattcattctcccttcccccttgccccttgcaaccacaaatctgctttctgtcagtatagatttgcttatgctagatatttcatataaatggaaccatacagtttatggcctttgtgtctggtttctttcacttagcataatgtttcaaggttcatattccattttatggctatactgcattttgtttatccattcattggtttgtggacatttaggttgtttctaccttttggctgttgtgaatagtgctgctacgaacattcatataaagtattcatatgagttcctgttttcaattatctggggcatatggtaattctacgtttaactttttgaagaaccaccaaactcttttctaaagcagccacaccattttacattcccaccagcacaatgtgagggttccgatttgtccacatacttaccaacacttgttttccaattttttgatcatagccatcctggtaagtataaagtggtatcttattgtggtcttgatttgcatttgcttaatggctagtggtgttgagaatcttttcgtgtgcttgttggccatctgtatatcttctttgaagaaatgtctgttcgagtcctttgcctattttttaattgggttgttgtttgtgttgttgagttgtaagaattcttttttttttttttttttttttttgagacggagtctcgcactttcgcccaggccggactgtagtggcgctatcttggctcactgcaagctccgcctcccgggttcacgccattctcctgcctcagcctcccgagtagctaggactacaggtgcccaccactgcgcccggctaatttttttttttgtatttttagtagagacaggggtttcaacgtgttagccaggatggtctcgatctcctgacctcgtgatccgcccgcctcggcctcccagagtgctggaattacaggcgtgagccaccgtgcccggccgtaagaattctttatatgtgtggctgggcatggtggctcaagcctgtaatcccaggatttagggaagccaaggcagtaagatcgcttgaggccaggagttcaagaccagcctggtcaacatagtgagaccccccatctctataaaataaaataaaaaaaatctttgtatattctggatgctaagtctttattagatattttatttgtgaatattttctcccattctgtaggtttgtcttttcactgtcttgatggtatcctttaacgcacaaaagttcttaattttgttgaagtctgattatccacttttccttgtattgctttgttagctcttataattacgtctttgatatatgttgagttaatttttgtatatgtatgagacaagggtccagcttcgttcttttgcatttggatatccagttgttcagcaccatttggtgaagaaactattctttcccccatttaatggtcttggcattcttgtaaaaaatcagctgactatatagatgtatggatttatttctggactaattcaattcatcactcccaatatctatccttatgccagtagcaaaatgacagtgttttgattactgtagttttatagtacatttggaaatcaggaaatgtgagtcctccaactttgttctttttaaatattttttggctattcagagtcccctgtgattccatatgaattttagtataagcttttctattcctgtgaaaaaggccattggggttttgatagggattgcattgaatctgtaggtcactctgtggactgttgacagattaagtcttcctgtccatgaactttctatttatttcagtatccttgaatttctttcattgatgttttgtagttttcagtgtataagactttcactccttggttaaatgtattcctaagtattttcttattgttattagaaatggaattgttttcttaatttctgttttggattcttcattgctagtatataaaaatacaactgatttttatgtgttgatgtatcctccaactttactgagtttgtttattagctccaataacttttggtggattattttggattttctatatataagagcatgtcaactgtgaatagagatagttttatttcttcatttcccatttttatttttcttatatacaaactttttttttttttttgagatggagtcttactctgtcgcccaggttggagtgcaatgggatgatttcagctcactgcaacctccacttcccaggtccaagcaattctcctgcctcagcctcccaagtagctgggattacaggcgctcaccactacgcctagctaatttttatatttttggtagagatgaggtttcaccatgttgaccaggctggtctggaactcctgacctcagatgatccacccgccttagcctcccaaagtgctgggattacaggtgtgagccactgcgcgcagctcttatctataaacttatgcttttcatttgtttgtccttttgctttttgtactgggataatttctcaatttttaagcggttgcatctcctattcagctattttttgtatcaagtattacattgttttaatttctagtaactgtagttcattcctttctttatcaatgtagtatattcacacatctctctgaatatattgaagtcttattctgtgttattaatgctatttccttggctattctgtttgccgagtttagtattttcttataatgttagttttcccttggtgtttagtgattcttagttgtgttctcttctttttcactcatgagattccttgttcatctgtctgtaagtgttttatgtaattaccgtaactttccttcagtaattgtgggaaaggtatgggacatgctccctggcactgtattttgtaacttatctctaatgctgcctggagggtggcccagtagctagtctccaaatgtaggagggcttacctttcttcctggatgtcgtctccttcctacatcgttgacctctttcttggccacaaaaccttttcctcttactgctcttatttgggggcgcatgcctctgctgccctttgcttggtctggaggtggggagagaagggacagaactgcctgcctgttccttctttgttatcccaaccagttcattcttccattcagtaaatatctctttagcagtgaataagtcaaaacctctgtttttgtggagtttacatctagtagaagaaaatggatactaaacctatatatggtagtcagggaaagacttgtatgtgatggtgacagtcataggcagagatctgttcaaggaaccaaaaggcggccagtaaacaggagagcattaagagataacattgaaagagacagaagatagatctgatagagttttgtaagcattctagcctaccactcatctttttagttggccagggttctctcctgctgcccgtatcagccactcaggtttgcagcattttgaaacaattcctacatatgtcatggtctactttttcctctgtcagtcatatatgcatgtgtctatgtatattttcctgttgtgtctgtaaatttggattgataaggaaggctagaacaaatatttaatttgccatcttgatccagttactacatattaaaattcttttctgtaatttcagtgggaccaatgtaacattttctaaattgtaatactgatttttttcttctcatgaaactaattattactagtttaaaatgagacttcagaaagtaaaaactgattgcttacaattttatttttaatatgtcctgacctgccataagtttgtgtttgtttttttgtttttttttttttgaaacaagagtttcgttcttgttgcccaggctggagtgcaatggtgcgatctcggctcattgcaacctccgcctccgggttctagctattctcctgcctcagcctcccaagtagctgggattacaggcaggcaccaccacgacaggctgattttgtatttttagtagagacggggtttcaccatgttggccagtctggtctcaaactcctgacctcaggttatctgcccacctcagcctcccaaaatgctggcattacaggcgtgagccactgcgcccagccctgccctaagtagtaataatgcttacccaagacatcatacttactgccatgtaggctatcttctttcaggcaaatgctaaatcccattctttgtgcttttatatatttttttaatcttctagattagtagtgacccttctcatgtttcccaaaatatttgtggttgtctgtgctaacttttcatattaattattataggggatttatctttaaagcactcatttagatacaacagttatatctggggcccttttgcggggagtagaaggacaagaagaggggattgattttatagccagcatagcctgacgttaacaagaatttttagagcatgattttgaagtaattttgatgtcctttataaatttccctatgctttcataaagtaagaaacttgatttcctgatacttctctgtaaatctaagtgcctagatatcttgtttttttctgtttttatgtgtttcaagcatctttaactgagtctcttaaataatataggcataaatgaaaatttccatgataatagcatggagttttagtaacctttttagtaaactggcacatatgaaggaaattttaatttgattttcagttttcaaagtttgtataatgatgaaaaatattctggggtagaagattaataatcttctcttttatttactaaagtctaaataatatttttaaagaaacaaggctttttataaattgagtactttgggttcagtctgatatgctactattaatgcaactatatacgtaatactctattttgggttaaagattagtctatacaagaaattccgtttttttttttttttaaaagcttcaccttacctaaattattaccactttggtttttctcggttgttttgttttgttttgttttgttttgttttgttttgttttgttttgtctccattaggagatgtcctcagatgcttcacttccaggggatccagaggcctatcctgctgctgtgtcaagcggtggagccattcatctgcagacaggaggtggatattttggcctaagctttacttgtcctagtctcaaaaatcctattagcaagaaatcctggactcgcaaattaaaaagctgggcatacaggctacggcagtcaaccagctttttcaagagatcaaaagtccgtcaaggtagtgtgcttacagtcagggacatagactaggtaacatcacttttcatttacttattttttttgttgttcatatacaaatcttgccactttttccacatagcccatgtatgtgacatgtcccattaatgtcattgccattttattttttccttttgtaactaatttggttttccggttattcatttcatatagatactaagtcttgggataaatcttgcaatgtctgatttagacttagggacttaatacaatgttgcttattacattaacaccttttaattgtctagcaggagttaagctttttctacttttcttcatttttggtaatgtaaacaaatttagtcttaacaaacaattttctcttttttacttacaatttggcaaaacttgcagtggaaacagaagagatgagatcagcaattgctcctgatcccattcctctgacacgggagtccacagctgatactagggctttgaatagatgtaaagcgatgagtggatcatttcagcggggtcggttccaggtttgtgtctttgattgaatccttatctacaagggcattataaaatataacagccagtggagatcttggtctgtagatgatacttccatttttgtttttatttttttttgagatggagtttcactcttgttgcccagttggagtgcaatggtgtgatcttagctcactgcaacctccgtctccttggttcaagcgattttactgcctcagcctcccgagtagctgggattacaagtgcgcgccaccacacccggctaattttttgtatttttagtagaaacggggtttcaccatgttagccaggctggtcttgaactcctgacctcaggtgatccgcctgcctcggcctcccaaagtgctgggattacaagcatgagccaccatgcctggccgatgatacttactttaaatgtagatcattgtcatatttaatttgttcatcttgcatgcatcccctcaccttttgaagccatcagtaaagatgaatctaaagaaatggagattttcatagctggtagagagcacagaaataggttttcttttggcgggtgggtgggtcctcttttataaatgtaatttcacgtcctttagaatctcagcaactctaattgtggaattttatttgagcaatatgatgcccactctctttacccaaggggcctgattgaaagagtgaatttgggggtatagattaaatttttaagttttgctagtatcaatacatatacatcacagcagagcatctacttgtctgtgctatgctaaccacttttacgtttttatatctcaggtgattacaattcctcagcagcagtcagcaaaaatgacatcttttggaatagaacacatatcagtgttcagtgagacaaaccattctagtgaagaagcctttattaaaacagcaaagtctcagttggtagaaatagaacctgccacacaaaatccaaaaacttcgttttcttatgagaagttacaagctcttcaggaaacctgtaaagaaaataaaggagttcccaaacaaggtgacaacttcttatctttcagcgcagcttgtgagactgatgtatcttcagtgaccccagaaaaggaatttgaagaaacttcagccacaggaagtagcatgcagtctggatctgaactgttgcttaaagagagagagatattgactgctgggaaacagcctagctctgatagtgaattttcagccagtcttgctggcagtggaaagtcagtggcaaagactggtccagagagtaatcagtgcttaccacaccacgaagaacaagcttatgctcaaacacagagttcactcttctattcgccatcttccccaatgagcagtgatgatgaatcagaaatagaggatgaggacttgaaggtggagcttcaaagattacgagaaaagtaaggactgtttctcttttgtcacaaatctggttgccctaggttttatagaacttagtattggattggtaactaatttaggattggtgacattttaatgattgaaaactacaaagaatgctaatgctaaacatttatgaatgagaaaaagttcttatatataaaatgttttcatagtctcaagactattacagttgcttatttaccaatatgatttaactactctttttgctaacctttacaatccttattcttcaggacttttggttttagattttacaactattcttatataatttcacatttgataagtaaacagctgatttattataatcagagatagtggttcatcttctttaggaaaaggtaagatactttcaagatcaagcttattatttggtgactgaggtaatcaaccttcactagtgatattatgataatatattttgtcaatagaatgctgttttgtatttagttttataaaataggtcatttaaaaaaaagaaattcaggccagctgggcatggtggcgcatgcctgtaatctcagcactgtgggaggcagaggcaggtgtatcacttgaggtcaggagttcaagaccggcctggccaacatggtgaaactttgtctgtatttaaaaaaaaaaaaaaaaatacaaaacttagccaggtgtggtggcagacgcctgtactcccagctacttgggaggccgaggcaggagaatcgcttaagcccaggaggtggaggttgcagtgagcccagatcgtgcgccactgcactccagcctgggtaacagagcaagactccgtctaaaaaaaaagaaaagaaattcatatttaagttgctgaattctaattctatccacatggttcaaaattcaaaaggtacaaaagggtaaccagtagtctccctcctagcactgcagctgaactatccaggttctctccttagacacaataaatattacctgtttcttgtatatccagttagtctataactgtacaaacaaatatgcatatttcattctttgttccccaaatagtaacttacactgcaagactgttcttatatcttggttttctttaccatttcatagtatcttggatatatatctgtatcattatatttttgactgtttcaaagtattccattatatgtatatactcataagttaattactagcctcctattgacgaccccatgcccttactttgaaaagttgaaaccaactctagcaatttttgaatatatcttatgctttagagaatttccacactgttctgggacttgaacaatttgtaaagcagggagaaccagggaggactaaataggcacgcaaaaagctggatttggccagacacagtggctcatgcctgtaatcccagcactttaggaggccgaggcgggtggatcacctgaggtcaggagtttgagaccaccctggccaacatggcaaaaccccgtctctactaaaaatacaaaaattagccagacgtggtggcgcgcacctgtaatcccagctactcaggaggctgaggcagggagaattgcttgaaccttggaggcagaggttgcagtgagtcgagatcgcaccactgcactccagcctgggtgacagagcgagactccatctcaaaaaataaaataaaaagctggattttagtcaagttcttacaagcttgaataatgctccacttggatgctacgttcaagtgcttcaagaattaaagcaggttaaaatccttggaaatttcttagtttctagggccttgcccagagaagaaaaaaacccaaaactgtcattccaatgatagataattataatattttctctctaacttgtttcagtgtttttaacttgagcttgcaagaaaattgtgaatatatactttaaatattcatcaccagaaggctgatattccactttaaaatatatatacaggcttgacattacattatgtatacgtcaacttatatattaagtactatacagtatatgtacactgatactttttataataaaagttattaaagcagtttcatatttgtgatataagtattctattgcttttgttttgttttggtttggtttttttggttttttttttttttgagacggagtctggctctgttgcctcagctggagtgcagtggcgtgatctcggctcactgcaagctctgcctcctgggttcacgccattctcctgcctcagcctcccaagtagctgggactataggcacccgccaccacgcctggctaattttttgtatttttagtagagacggggtttcactgtgttagctgggatgatctcaatctcctgacctcgtgatccgcctgccttagcctcccaaagtgctgggattacaggcgtgagccattgcacctggccttctattgctgtttttaatggttcttttaaaccattgtcaaatgactggtagcttttgtagctggctagttttttgtaactgggtggttatgaatatctacttaattttgaatgtgagacatggattctcataacctcatagaacccaagacctggaaaggatcttttattttgagacagagtcttactatgttacccatgctggagtgcagtggtgcagtcatggatcattgcagcctctacctcctgggctcaagccatcctcccacctcagcttcccaagtatctgggcctacagacgtgtaacacatccagctaatatttaaatttttttgtagagatgaggtctccctgtgttgcccaggctggtctcagacttctagcctcaggccatcctcctgtctcagcctcccagagtgctgggattataggcatgagacaccatgcctggcctagaagggatcttaaaagataatttattcatccttcagtgttcttttagcattatggtttcttcaccgatttttattattctttcttttattactattacaattattattattaagatgaggtcttgctctgtcacccaggctggagtgcagtggtgctgtcatggctcactgaagccttgacctctggctcaagagatctacctgcctcagcatcccgagatgcttgtactacaggcacgtgccatcatacctggctgatttttttttttttttttttcagagagacagggtctcactatgttgtctaggctggtattgaactcctgggctcaagcgatcctcctgccttagcctcccaaagtgctgggattacaggcatgagccactgcgtctggcaaaaaatgttaatattattaatactatttgactttacattttgttttactgactttcactgtatttcagttttagaaatttgttaatctttttcttcatgagtgattattacagttaaatgttatgcttaggaaggcatttcccacttcccctccggaaattgtgaaaatactctgtatttcctccttccttccttccttccttccctccctccctccctctctctctcgctctctctttctttctttttttttttttgacagggtctctctctgtcacccagtctggagtgcagtggtgtgatcttggctcactgcagccttgaatacctgggctcaagtgatcctcccacctcagccttttgagtaggtgggactacaggcatgcaccaccgtgcccagctaatttttgtatttttttttttttttttttagagagatagggtcaccctatgttacccaggcttgtctcgaacttctagtctgaaacaatactcctgcctcggcttcccaaagtgctgggattatggatgtaagccattgtgcctagtctctatttccccattcttaatctaaattccttgttaaactttacttatactggtttagagtttcttggctcatctttatggagccagtgccattaaaatgctttttgcatgattttcattcagacacattcaggaggtggtaaatcttcaaacccagcagaataaggagctgcaggagctctatgaacgccttcggtcaattaaagatagcaaaacccaatctactgagattcctttgccacctgcatcaccacgtcgaccaagatctttcaaaagcaaacttcgaagccgcccccagtccttgacacatgtggacaatggcatagttgctacaggtaaatcagtcataaaagtaatttttaaaaaatctagtccaagattagcaaaattagtaaaatgattataatacaatttatttttaattaggctaaaataatttaaagaagtacacattattctgagattattttctgtttttgatgttaaatgtccttttatgtagtaatgattaggataattgatagattgtaaagagaagctgagtatggttcatgcttttatttggaaaaccagcagctggaagcccaatgccaatccccacaataatttttgaaatgttatcagtcagtgggaacttctggtctagcatttagagtttgttggagagtttgttggtaacaagataatcttaaaattatactcggccaggcgcagtggctcacgcctgtaatcccaacactttgggaggctgaggtgggcctgtcgcctgaggtcaggagttcgagaccagcctagctaacatggcgaaaccccatctctactaaaaatacaaaaattagctggatgtggtggcaggcgcctgtaatcccagctactcaggaggctgagatgggagaattgcttgaaccctggaagcagaggttgcagtgagccgagattgtgccattgcactccagcctgggcgacaagtgcgaaactccatctaaaatacatacatacatacatacatatatatatatatatatatatacacacacacacacacacatatacacagacacacacacacactcaacaagaatgaaactccgtctcataaaaagaaatacatacatatatatacactcatgctcttatctgaagagatctttattagttataagaatattagtaaaatatacttctttgactttgaaaaataagagcatcaatctctacttaactaatatagaagttgttaatcaggtcaggcctctttggttatatgtgcatagtcaaggtgggggttaaggatgtattgtaaggacatatgtgaaatcccaatggaacttgtcgtaggcagaataattccccccgaaaacgtccatgtgcaaatctctgaaacttgtgaccatggtaggatatatggcaaaggagaattaagcttgcagatgggattaaagttgctaatctgctgactctaagatagggagattatcctggattatccaggtaggtccagtgtaaaatcactaggatctttaaaagtagaagagaagaaacacagaagagtcagagaaaagggaaacagtgtcagaaaggtgcaacattgctggctttgaagatggaggaagagtgccacagaccaaggaatggaggcaacttctggaagctggaaaggccagggaacacatctctcctatagccttcagaaggaacacagtcctggcaacaccttgattttaggccagtgaggcccatgttaggcttgtaacctagagaactataagatcaatttgtgttgtttgaagccactaagtttgtggtaattagttacaacaacaatagacaactaatacagaacccaagaaaaggaactgtacttggatgatcttgtaaagacagaattaaggggtagacttagattgaaggcagctctggggatttaatagcagaagtacatgaaccttcagtctgatgcagtatcactaatagctatactttattttattctgtttcattcccaaatggcttcattttatgcatagtttctgctttcccaaaactgttagataacactggttactcgtgatcccaaagcattctttcactttcaggtccttatttaactgacctttgttagattccagggacagaaaatttgactgtccctgctcatctttttcatgccaagaaatgggtcagagcccattgcctggcctatagttgggctgttctacagtcaggtgtccacctgtttctaagtaagcatggccagagaagtatgatctcatggtaaaaacatgtctctggaggctgtctttgggattcctcaacttattttgtgttataatggatgtaccacagtttgtttatccattcatcggttggaggacatttgggttgtttctagtttggggttttacaaataaagctcccgtaaatagtcacatacagctttttgggtgaacataagttttcagatcacttggatgaaatacccagaaatgagattgctgcatcatatggtatgcatatttaacattttttaaaaactaacaaaccattttcccaagcagctgtatcattttacattttgtcagcaatgtgcgagacttccagtttttctgatgctcttcagcacttggtattactagcattctttttttagccaatccaataggtatttgatgatataaagtggttattttattataattttcattcccataatggttagtgatgttgagcattttttttcttgcacttatttgtgatctgtatatcctctgtggtaaagtgtttgttcaagttttttgctatttttttgtatcctgttttatttttaattgaaattttcattgagataattgtcgatttacatgcagttaaataatacagagagatgctatgtacctatgtatcctttactcagtttatcccaaaggcaacaatttttgtcattttagaaaattaggttgttggttttcatatggttgattttcgagagttttttctgtatttttgataaaaatcctttgtaggacatgtgatttagaaatatattattcaagtctatagcttgtcttttcattctcttaacagtgtcattggcagagcgaaagtttgtgattttaataaagtatactttatcaaattttttttaaaaattgtgattttggtgtaatatttaagaactctggctaaacacaggtcacaaagattttcctctatgttttctcctaaaagtttaatagttttatgtttacatttagatttatgacacatttggaattactttttgtatgaggtgtgaggttttgggtgaggttcttttttgcatattgatattcaattattacattaccatttgtggaagagaccgtcctttctccattgaatagcttttgtacctttttgaaaaatcaattagccatatatgtgtcaatctctttctggactctttattctgttccaattaatctatgtgtctgtcctttcaccaataccacactattttgattattgtagttttatagcaacttttaaaattattattgttaaaattaggtattatgtttcctgaaactttgttttttttcaaaactgttttagctactctacttcctcttccttttcatataaattttagaatcagcttgactatatctaaaaaaatcctgctgtgattttgattggaattatgttaaatctatatatcaattttggggagaattgacatttttactgtgctgagtcttccaatcaataaacgtaggctatctctccttttttttgtctttttttttaacttttattttaggctcaggggtacatatgcaggtttgttatataggcaaattgcatgtcatgggggtttggtgtacagtttatttctccaggtcttcttagatatgttttatctgctttttatagttttcagcttacagattctatatgtgtttcgatttatttatacctaaggatttattttatttctacagggtttccaatcacacattgatagagaaatatgattaatttttgtgtatcgaccttacatctgaagattttgctaaacatatttgttctagaagttttcttatagattctttgggattttttgagtgagcaattatgtcatctgcgaatatagacttttttgtttctccctttttaatctttatgccttttatttcttcttactattgtactagctaaaactttatattggacatccttgccttgttcttccaaggagaaagccttctgtcttttgccataaattataatgttaactgtaagttttcgtatatgccctttattaatttaagttcaataagtatgttggtttacagttttcatctttttgttttatattttgaaaattttgatactatctttttctggtttgatatcagggaaaagctgccttataaatgagttggaaagtaagtatttcttttgcttctttacttttaatttttttaaaaaattacagttttattgagatatttcacatatcataatgttcactcatttaacttatacaatttacagacttgtgcagctattaccacaatttgattttggaatattttcaacattccacaaagaaacatgtacatattcatagtcatccctcattgtagctcctctaccccaaacccccaaccacaggccctaggcaaccacaaatctgctttctgtttctatagatttgcctatgctgaaacattttgtatcaatacagttacacaataatatgtggtttcgtgactggcttcttttacttataatgtttttgggagtcaaacattttataacatgtatcagtacttcattttttattgctgtataatattaaaatgtatgtttatccattagaacactttcatcacctcaaaaagaaatcccttttctatgagtagtagcccccgccatttattcccacttcccccatcctccagcctcatcaatcactaaagtattttttgtctctatagatttgcctgctcttttttgggaggccaaggcaggaggattgcttgagcccaggagttggagaccagcctgggcaacaaagtgagaccccatctctataaaattagccaggcatggtggcgcacgcctgtagtcccagctactcagaaggctgagacaggaggattgcttgagcctaggaggttgaggctgcagtgatccgtgttcacgccattacactccagcctgggcaacaagcaagacctgtctcaaaaaaataaaataaaataaataaaataaaataagatttgcctactctggacagttcatgtaaatggaatcatacatcatgtggtcttttgtgacttttttcacttagcatatatttacaaagtttaactgtgttgtaacatatattggtacttcatttctttttgttgccaaataatactccattgtatggatatgccacattttattcattcatcagtgattacacatttgtgttgttttctcttttttttgctattatgaataatgctgctatgaacagttgtgttcaaatttttatgtggacatttgttttcatttctcttggatagatatgtaggagtggaattgctagatgacatgggaactctatgtttaatcttttgaggaattaccagactttttttccaaaatagctgcaccattttacagtcataacagcaggacatgagggttcaacaactcaacaataaaagattcaaaaatccaattttaaaatgggcaaaagattcaaataggcatttttctaaagaagatatatgaatgactgataaatacatgaaaagatgttctgtaatattagttattaaggaaatgtaaatcaaaggcacaatgagataaaactttacacccacttaaaatggctgaaatttaaaaaggcaattcccaaggacataggacatatgaggcgaaaaaaagaaaaaaaaatttttaagacagtagcaagtgttggagggaatgtagagaaattgttgagttgtgagtaaggactagagccttactgaatatgattttgcaaataatcatctcctattcttagattgtcttttcactttcttgatagtgtcttttgaagcacaaaaagtttttaatggttttaaaatctaatctgtttcttttcttttgttacttgtgcttttactgtcatatctaaaattccgttggctcaccattgactctatagtaattgaaaagaaagagaaaaaagaaaaaaaatctattgcctaacttaaggtcatgaagatttattcctataatttcttttgtttgtttgtttgttttgtttcgttttgagatagagtctcactccgtcgcccaggctggagtgcagtggcgcgatctcggctcactgcaacgtccgcctcccaggttcaagcgattctcctgccttagcctcctgagtagctgggacacaggcgcgtggcaccacaccccactaattttttatttttagtagagacggggtttcaccatgttggccaggctggtctcaaactcctgacctcaggtgatccgcccactttggcctcccaaagtgctgggattacaggcatgagccaccgtgcccggcctattcctatattttcttctaggagttttatagtgaatctcttacatttagttctttttttttttcttcttctttttttttttttttttttgagacagagtctcaccctgtcgcccaggctggagtgccgtggcacaatctcagctcactgtaacctccacctcccaggttcaagcgattctcctgcctcagcctcctaagtagctgggactacaggtgcatgccatcacgcctggctaatttttatatttttagtagagacagggtttcgccatgttggccaggctgatctcgaactcctgacctcaggtgttccacccgcttcggcctcccaaagtgctgggattacaggcctgagccgctgcacccggctacatttagttctttgatccattatgagttaatttgtgcatatggtgtgagttaaagatccagattcttttttttttttttttttttttttttgggtatgtggatatctccttgtcctagcactttttgttgaaaagactatttttcccccattgagttgtcttggtacccttattgaaaatcaactgaccagaaatggacagatatatttctgtaatcttaattctactccgttgatctctgtgtctggccttatgccaatcccataccatcttgattcctatagtttatcatgtgttttgaaattgtaaattgagttctctaaatttgttcttatctttcatgattgttttgactattctgggtaatttgaattttcatgtaaattttagaatcagcttgtcaatttctgaaaaaaacagttggaatttagagtattgactctatatatcaatttggggagtattgttatctttaaaatgttgtcttccaatctgtgaacatggtatgtctttctgtttattcagattgtctttaaatttctttctttctttttttttttttttttgaaacagagtctctctctgttgcccaggctggagtgcagtggcatgatctcaacttactgcaacctctgcctcctgggtttaaacaattctcatgcctcagcctcccaagtagctgggattacagacgtgcaccaccacacctggctaatttttctatttttggtagagacagggttttgccatgttggccaggctggtcttgaactcctgacctcatgtgatccacccacctcagcctcccaaagtgctgggtttacagtcgtgagccaccacgcccagccaggttgtctttaaatttctttcaacaatcatttttagtttttagtgtataagttttgtgcttattattattattattattattattttgaggcagggtctcactctgttgtccagggttgagtgtagtggcatgatcattgttcactgcagcctcaacctcctggtctcactcaagtgatctttctgcctcagactcccaagtagctgggactacaggcacatgccaccatgtcctgctattttttttttttatttgttttagagacaaggtctccttatgttgcccaggctggtcttgaactcatgtatgctaaagaaaagtatgtattctggtgttgttgggtggagcgttccatatatgtctgttaggcctctttggtttagagggctgttcaagtcttctatttctctgttgatcatctgcctagttctatcagttattaaaagtgggttatagaagtctccaactggcagggcacggtggctcacgcctgtaatcccagcactttgggaggccgaggtgggcggatcacaaggtcaggagatcaagaccctcctggctaacatggtgaaaccccatctatactaaaaatacaaaaaattagcccagtgtggtggcgggcgcctgtagtcccagctactcgggaggctgaggcaggagaatggcgtgaacccgggaggcggagcttgcagtgagccgagatcttgccactgcactccagcctgggcgacagagcgagactccatctcaaaaagaaaaaaaaaaagaagtctccaaccattgttgaatttctcccctcaattctgtcaattttgcgttgtgtattttggaacacacttgcacacatatgtaataattgttatgtcttcttaatttatatttcattttatttggctgaaggagaattattattattatttgtccagaaaactcaacagtctacatttaacccagcttaatgggaaggtgttttttttttttttttagatggagtttcgctcttgttgcccaggctggagtgcaatgacgtgatatcagctcactgcaacctctgcctcccaggttcaagcgattctcctgcctcagcctccctagtacctgggattacaggcatgtgccaccacacccagctaattttgtatttctagtagagatggggttctctatgttggtcaggctggtctcaaactcctgacctcaggtgatccgcctgcctcagcctcccaaagtgctgggattacaggcgtgagccactgcgcctggccaatgggaagttcttaagcctttgccttttccagcttggcaatgagagccagagattttggacccaggatattgcctccctagtgacagtggatctcatcctgtctgtcattgtcattggttctgatggcttccaccagcttagccaaagctcctttgtctgccaagttaatctgtgtgaaggcgacagtggtgcaagtcttcctgtggactagacatcccagtcttctcttccctttgtattttatgatgcagggcaggcaggaagacagctagctctatgagatccattgtcacgtgcagtcaccaccagctgagctttcttgttctccaccaaggtggtgacagcattaatccctgctcaaaggccttagtggagacatccctctggcaactttcttctcagtctggaccaatgatcttcttgctttgtctctggtctgtccttataggccagcttaagcagttgtgtagctatttggcagtccaaggcctaggtaaactggttatttgcaggaggcactttcagctgcttttagaagatatatagatccttgctgctgcaacctgatatagcagggccatctgacaaagtgggtgaggtccctttagggctggatgtcctgttcagtgccaaaattcttaggccttttctcaaacgggattcatcaccttcttcgcctcctgcttcctcacaatagcaggagagggggccatcttcttccacttagccttcattccttttggcattttgaatggctagaggagagattatttctgatattagtacaaccaatccagctttcttttggttactgcttgcatgccatatctttttctgttcttttactttgaatgtatttctgtctttaaatcagaattgtgtttattgttatcatatatagttaaatcatgttttttattctgtcaatctgtcttttgattggggcatttaaatcatttccatttaatgtaaggtaggatttatgcctgtcattttgttatctttgttttctatatatcttcgatttttttctttttttcctcatcctctgactctccgtattcctgccttcttttatgttaaatagatattttccaatgtagcatttaaattctattgtgtctttttttatatatatatatatatatatatattattattattattattattatactatacttttttttttttgagacagagtctcactctgtcacccaggctagagtgcagtggtgcaatctctgctgactgcaacctccacctcccgggttcaagtgattcttctgctcagcctcccaagtagttgggactacaggtgcataccaccatacctggctaatttttgtatttttagtagagacgaggttttgccacatcggccaggttggcctcaaactcctgacttcaggtgatctgcccacctcagcctcccagagtgctggaattacaggcgtgagccaccatgcccggcctattatactatacttttcatttttcttcttttttttgagacagggtctcaccctgtcacccaggctggagtgcagtggtgtgatcatagctcactataacctcaacctcccgggctcaagttatcctcccacatcagcctcctgagtagccgggaccataggcgcatgctaccatgctcagctaattaaaaaaaaaaaaatttttttttaaatacaggctctcactgtattgtccaggctggcctcgagctcctgggcttaagcaatcctcctacccagcctcccaaattgctggtattacaggtgtgagccaaagtacctggccctatattattcttttcttatatttttcagttattttcttgtggtagccacaatgagcttcttaatttaaaagcaatctagttcagtttttttgtgtgttttttgtttgttttgagacgaagttttgctcttgtcgcccaggctggagtgcaatggtgcgaccttggctcactgcaacctccgcctcccaggttcaagcgattctccttcctcagcctcctgagtggctgggattacatgtacctgccatcacgtgcagctaatttttgtatttttaatagagacagggtttcaccatattagccaggctggtctcgaactcctgacctcaggtgatccacccgcctcagcctcccaaagtgttgggattacaggcgtgagccaccacacccagtcatgtttttttgtttgtttgtttggttggttggtttttttttaagatggggtcttgctctgttgcccaggctggagttgagtggcgtgatctcagctcactgcaacttctgcctctgggttcaagcgattctcctgcctcagctacctgagtagctgggattacaggcgtgcgtcaccatgcctggctaatttttttgtatttttagtagagatggggtttcaccatgttggccagactggtctcaaactcctaacctcaggtgatccgcccgcctcggcctcccaaaatgctggattacaggtgtgagccacctcgcctggcctctagttcagtttaatactaaattaacttcaatggtacacaaaacatttctctaatatatgtgtgtgtaatacatacacacacgtattccctcacaacttctttgtactattattgttatacacattacatctttacatgttataagctcattgacacaattttatagttattgctttatgcagttgactttgaaatcaggtaggaaaagtagagttataaatacaaagtacatttatactgaatattatatttacctatgtagttctcttcagcagtgtgctttattttttcatgtggatttgagtaactatctagcattcttttatttcatcctaaaggactcactttaatatttcttgtaagttaggtcagctagcaatgaatttccagttttttattagaagtgtttctatttttattttttttccatttatggaatttgtttttaaaaaacaaggacataaaggactagcttaaattggatcaaaggctgttaaaggtcctggtacaattcaccttataaaacataaggtatgagaaagtatgcctgtgttttgtttggtgagtagaaaataagaaggaaattttggtgatttccaattcaagtgtgtcactgctgtgacagcttccagctcacagaaacatctggtattcttaataccttctattctggcccaggttaaatttctttaattatatacaacaagtagaatcctattttaataggaactctaaaatagctagctatttaaaactcttctctttattgatgcttccttttcagccataaagttgatagaaaaaatactgaaaagtacaaaattgaaaaaaaattattttgcttaataagtctattaataaagttttattttatgcaataagacacctaaaaatttgaaaggcaaaatcattcttgtaaaataaagccatttggatttagactttctagggttttgggaaataatgtaaaaaaataaagattccatttgttttgtttttgagacagggtctgaccctgtccctcaggctgaagtgtagtggtgccatcacagctcactgcagcctcgacctcctgggctcaagtgatcctcccacctcagcctcccaagtagctgggactacaggtacacactaccatgcccagctaattttttttttaatagagatggggtctccttatgttgcccaggctggtctacagcttctgagctcaagtgatctgcccacatcagcctcccaaagtgctgggattatttaggaaaggtcttattctaaaaatgcttggttcaatggaaattcagattttttagtattctttgtattccagtcatcaagaagaactagttattagaatgagcattgaaagtataaagttccttttgcatgttcccaagagttagtcatcttccatttttcaaatcttttttacaacaaatattttgcttttgatacttaacattaggtctctgaaataaagaataggtaaacaaaagagtaaatctagaggcatggctactttactgttataactggttatttccaaatctcagttgtatataccttatccacttctcccctggtatatagactagcttttatccacctttgaactctcacaactgaacagttggctcccaaaagacagtgcacagtttggtgcccttaactctattacatacttttcacaagacacacttcttttcctatagattaaaattcacctatagaaaactgttactcattttcttaaaacataacaatctccaactacatgcagagcatgatgtctatgagaaggtcaccctcttcaaggagtttatagcacagtgttatgtgtggatctccttcctttttttttttttttttttttttttttttttgggagatggagtctcgttttgttgcccaggctggcgcgatctcggctcactgcaacctccgcctcccgggttcaagtgattctcctgcctcagcctcccgagtagctgggattacaggtgcccgccactaggcctggctaatttttgtatttttagtagaaatggtaccaccatgttggccaggttggtctcgaactcctgacctcaagtgatctgcctgcttcagcctcccaaagtactgggattacaggtgtgagccaccgtgcctggccgggtctccttcatttttgaaagatttaggtgaattcttctttgatagtcttactctttcaacactttgacagtgtcatcccattgtcttttggcctgtatggtttccaatgagaagtcagctcttaattttattgaagtcccttatacatgacaagtctattttttgtcttctttaaagattttctttttgtctttgattttcatcaatttgattatgagtgtctaggtatggatctcattaaatttactttagttatagttcactgagcttcttgaatgtgtaaattaatatttgtcattcagttttggaaatttggagttattatttattctgatattttttctgcccttttctcttctatttttggaactcctattatgcatatttgtcatgcttgatggtgtccaacaggtctgtgaggctctttcacttttttaaatttttttattttttattttatctatctatcaatttatttatgagacagagtctcattttgtgaatttatttatgagacagagtctcactttgttacccaggctggtgtgaagtcgtgtgatcttggctcactgcaacctccgcttcccgggttcaagcaattctcgtgcctcagccccccaggtagctgggattacagacgcgcaccaccacacccggctaatttttgtatttttagtagaggcagggtttcaccatgttggccaggctgatctcgaactcctgacctcaagtgatctgcctgccttggcctcccatagtgctgggattacaggcgtagccaccacacccggcctctttcttttcttttcttttttttttttttttaattcttttttctttctgttcttcaaagtggatttcttcatcaacctgttttcttgttggttgattatttctttttcccactaaaatctcttaatgggcccctctatataatttttcacttcagatactgtatttttaagctctagaatttgctttttaaaaacaacttccatctctagtctctatttggtgagatattgttgtcacactttcctttaatttttttaggcatagtttccctaagtttggatatacagtttgtcccttggtatatgcggagatcagttccaggactcctgcgtatgccaaaatccacacagtcaagttccacaggtggccctgaggaatgcacatatatacaaaatgtcagccctccatatatgcaggtttcacatcccagaatactgtattttcgatccatatttggttgaaaacaatccacatataagtggacctgcacagttcaaacctgttttgttcaagggtcaactgtatttataatagctgatataaaagctttgtctactaagtccaaaatataggccccctccaggatgtttttgttgggtccccttttttcctgcatatgtcatgctttcctgtttctttgcgtgtctcttaattttgtggtgcaaactggacattttaaataatatattaaagaacttctagtatcggattcttctacccctcaagggttgttgttgtttttcttgttgctaattatttagtgattttcctggacaaattttacattccctgcagtgtatggccattgaattccctgctggattttctttttcaaagagccatggctggagtgtagtggcatgatctagttcactgcagcttcaaactcctgggctcaagcaatcctcctacctcagcttccttagtacctgggactaataggtgcatgccacaacacatggcaatttttttttttttaagagaccaagccttgctctgtcaccagactggagtgcagtggtgtgatctcggctcactgcaacctccgcctcctgggttgaagcaattcccctgcctcagccttatgagtagctgggaccacaggcacacgccaccacacccagctaattttttgtgtgtattagtagagatggggttttaccatgttggccaggatagtcttgatctcctggacctcatgatccacccgccccaaagtgctgggattacaggtgtgagccaccgcgcctggcccacatggctaattttttttttttttttttttgatggagtcttgctctgtcgcccaggctggagtgcagtggtgcaatctcagctcaatgcaagctccgcctcctgggttcatgccattctcctgcctcagcctcccaagtagctgggactacaggcgcccacgaccacacccagctaattttttgtatttttagtagagatggggtttcagcgtgttagccaggatggtctcgatctccgacctcgtgatctgcctgccttggcctcccaaagtgttgggattacaggcgtgagccaccgtgcccggcccacatggctaatttttaaaatttgtgtaaagatggggtcttgctatgttgtccaggctggtctcaaactcctggcctcaagagatcctcttgcctcagcctcccaaagttctgggattacaggcatgagccaatacacctggcctccctgttggatttgtttttatttatttatttttaatttttaagcctggtttcccaaggttcacacctgggctagtgccgtttagtgatgagccatgattggtcagaagagttcactaagtgccttgcctggatatcttttccaaagggatctctgttagagatcaaacttcagacagtttgtaagacaacctttgatttacttcctgcttgcctaggaactcaaggtcaaccagaagtgagtgattggcaccttctcctttcttaggtctttcgtgggcatgccagacttttatattgccaagaatatgttagaggttttcaaagtttcttatggtcatctagttctcccagaattcccttttaattctagtctaggttcttatttgccccaactgaaatctcagccttaggcagctgagttgttgcctgcactttcccatagtttcagtaatgccttgcaggtagccccctactctccatcccactatgctcttccactgccaggtgagcagagctttgagtgaaatcaaatctccaccacacttgggaaatagaaatctttccagggtgctgcaaaatatatatatatatatatatattttagtatttattgatcattcttgggtgtttctcggagagggggatttggcagggtcataggacaatagtggagggaaggtcagcagataaacatgtgaacaaaggtctctggttttcctaggcagagggccctgccgccttccaccttccgcagtgtttgtgtccctgggtacttgagattagggagtggtgatgactcttaacgagcatgctgccttcaagcatctgtttaacaaagcacatcttgcaccgcccttaatccatttaacccttagtggacacagcacatgtttcagagagcacggggttgggggtaagattatagattaacagcatcccaaggcagaagaatttttcttagtacagaacaaaatggagtctcctatgtctacttctttctacacagacacagtaacaatctgatctctttcttttccccacatttcccccttttctagtcgacaaaaccgccatcgtcatcatggcccgttctcaatgagctgttgagtacacttcccagactgggtggcggccgggcagaggggctcctcacttcccagacagggcggcggggcagaggtgctccccacatcccagacgatgggcggccgggcagagacgctcctcacttcctagacgggatgacggccgggaagaggcgctcctcacttcctagacggggtggcggccgggcagaggctgcaatctcggcactttgggaggccaaggcaggcggctgggaggtggaggttgtagcgagcggagatcacgccactgcactccagcctgggcaacattgagcactgagtgagcgagactccgtctgcaatcccggcacctcgggaggccgaggctggcagatcactcgcggtcgggagctggagaccagcccggccaacgcggggaaacccgtctccaccaaaaaatacgaaaaccagtcaggcgtggcggcgcgcgcctgcaatcccaggcactcggcaggctgaggcaggagaatcaggcagggaggttgccgtgagccaagatggcggcagtacagtccagcctgggctgggcatcagagggagaccgtgcaaagagggagagaggagacggagagagagggagagctccagggtgctgcaaaatattgactgtgcactggagatggtgtttttttttttttttttttttttgagatggagtctggctctgtctcccaggctgcagtgcactggcacagtctcggctcactgcaagctccgcctcccgggttcacaccattctcctgcctcagcctcccaggtagctgggactataggcacccgccaccacgtagtggcgtgatcttggctcactgcaagctccgcctcctgggttcacgccattttcctgcctcggcctcctgagtagctgggactacaggcgcccgccaccacgcctggctaattttttgtatttttagtagagacaggggtctcaccgtgttaaccaggatggtctcgatctcctgacctcgtgatccgcccacctcagcctcccaaagtgctgggattacaggcgtgagccaccgcgcccagcctggagatggtgtttttaagggagctcaaaaagaggtatgattgctccattgtctgcagtgctgctgtttgttggctaccacaacgctgagctggggaacaagggggaatgagaattgccccaagtcaaagtgtcacagatgccagtagtttccatagtttgtctttcatagaggtttttagttttattctatggctttggataattgtcaggggtggttggttctagttgttttgcctatatttttattgtttttgaatacaagaaagtttacccaggcccttattctgcatttttagaagtccatcttctccttccttttctattttctgaagagtttgtcttgagttagtattatttcttctttaaatgtctgggaaatttttccaatgaaaccatctgggctcagagatttcttttttgggaggtttttaacttttcaaacttttggccaggcttggtggctcacggctgtaatccaagcactttgggaggccaaggcgggaggatcatctgaggtcaggagtttgagaccagcctggccaacatggcaaaaccccgtgtctactaaaaatacaaaaattagccaggtgtggtagcggtggcacgcgcctgtaatcccagctaccagggaggctgagacaggagaagtgcttgaacccaggaggtggaggttgcagtgagctgagattgtgccactgccctccagcctgggtgacagagtgagactccatctcaaaaaaaaatttttttttcaaaaataaatcaaactcttcaatagtagttacaggattatttagattacgtatttcatgttgggtgagtttcggtagtttgtggttttgggggggacttgttccattttgtctatgctgttgaatttttgtgtttacagataatatgaacattatatttaatatctggggaatgacgtcacctttcattcctgatatttaatttgtcttctctttttttctttgtgattcttgatagaagcttatcaattttatctttacaaagatccagtatttgcttttattgatgtttttctctactgttttcccattttaaattttatggatttctgctctttattattttctgccttctacatgccttgtggttattttgatcatttttttcccctagtttttttttttttgtttgtttttttttttgagacggagtctcactctgtcgccctggctggagtgcagtggcgcgatctcggctcactgcaacctccacttcccggtttcaagcgattctcctgcctcagcctcccgagtagcagagattacaggcgcccaccacttcgcccagctaattttttgtatttttagtagagactcggtttcaccatgttgaccgggctggtcttgatcttctgaccttgtgatgcgcccacctcagcctcccaaagtgctgggattacaggtgtgagccaccgctcattatctcttatttttgtcctttaaaatcatttgggaggccgaggcagcaggattacttgagcccaggatttcaagaccacccctggcaacatagtgacaccccatatctacaaaaaatttaaaaaaaaaattagcccgtcatggtagcgcacacctgtagtcccagctacgcaggaggctgaggtaggaggattgcttgatcctgggaggttgagacttcagtgaacagttattgttattgcaccactgcactccatcctgggtgacggagtgagaccctttttcacaaaaaagaaaccaagatttgagtgcttgaggtatcattgcttctaggccctcttagctgataaggaactatacatgtgtatactaacatatatatacacacacatatccctacctatgaatatttctatatgtaatcatctgtatttatattaaggtaaatttgcattcatattgatgtctccaactctaatccattaccacatggatcattctgcccttatcgacttatctatttgcttatctgtaacctcccactccagaagtgagaaacctggctcccaccatcctccagccatttacttgtttaattccagtgtacaggtatcgtagtttcagaattttaacccaaaccctagtgggaaatacttttataaagtaaaatacaatgcttatgtacagtttcttttgccttcagtattacaggtgccactcatttccaaagttatatatagttcagcatctgttcttttacccgcttatatgaggttgcttcatacattttcaatatgattagatgctttcatcaaattctacattcccttctgggattccctgacctcctaaattgctttttaaacttgcatatattaaggttcattctttgtgccttttctgtgcattttgacaaatacattctatcctgggatctcatgacctcctaaatgatttttttttttacctttgcatacattgaagtttattctttgtactccagtattccctaggttttgatatattatattttctttgttgttgttgttcttgagacggagtctcgctctgtcccacaggctggagtgcagtagcgtgatctccattcactgcaagctctgcctcccggtttcacgacattctcctgcctcagcctcccgagtagctgggactacaggcacccaccaccatgctcggctaattttttgtatttttagtagagacggcatttcactgtgttagccaggatggtctccatctcctgacctcatgatccgcccgcctcaacctcccaaagtgctgggattacaggcgtaagccacagcacccggccctatattttcttttttttttgagttctaaatgttttctaatttcccttgagacttcctcttttatccatggattattggtagtgtgttgtttaattttgaagagtttggagatttttctcattgtctctttttttttgaggcagagtctcgtcctgtcacccaggctggagtgcaggggcgcaatcttggctcactgctacctccgcctcccgggctcaagcgattgattctcttgcatcagccttccgagtagctggggctacaggcgcccgccaccacgcccggctaatttttgtatttttagtagagacgatgtttcaccatattggccaggcttgtcttgatttcctgaccttgtgatcctcccgcctcagcctcccaaagtgctgggattacaggtgtgtgccaccactcattatctcttatttttgtactttaaaatcattatggttagagaacatccagtcagtctgagatatgtggagtttttttttttttttttgagacagagtctagctctgttcccaaggctggagcgcagtggcatgatcttgactcactgcaacctctgcctcccaggttcaagcgatcctcccacctcagtctcccgagtagcttggattacaggcacgcatcaccacacctggctaatttttctatttttagtagagacaggatttcaccatgttggccaggatggtctcgaattcctgacctcaggtgatccacctgccttggcctcccaaagtgctgggattacaggtgtgagccaccacgctcagcctgacatgtggagaatttatcaagtccctatggctatctcacttctcagatctccctgttaacctcaggctaatggagtacctgcttctaaagttctaaatcaagtgaatcccctatggtagcagcaacagcagccaaacttactgttttctcagaatgccccactttgctgggcaacagagctgggtgggggtgatgggaacagccttgtgcaaaaacaccacagattgcacagttcttacctgaaaagttcagtagttttcacgaataaatgcttctgattttgttgtattccttaggacaaattctggagtactaaagtgattgtttttgaattttgtccaattttaggattccttttgagggaggtttcttaacgtcctcactctgtcatactggaagccagaaattattttttttcagtaggcaggaaggagagtatctgattattgtacttctgttaaattaacttatttattaaaatatttagatgggttccaaaccagactttgttatttatctatttattttttagagacagggtcttgctttgtcacccaggctagagtacagtggctcagtcatagctcactgtaacctcaaactcttgggctcaagcaatcctcctgcctcagcctcccaagtagccaggactataggcgtgtgccactgtgcctggcaaatcttttttaaaattttttttgtagagatggggtcttgctatgttgcccaggctgatttcaaactcctgacctcaagcaatcctcccacctctgcctccagagtcattgggattacaggcgtgagccactatgtcaggccctcgaaccagatttaatataaaaatggtcatgtcttcttaagtaggaactaaattatcttcattttctttttctttttataactcatggaggccaagttcacaaagacaggatgctccacatgtaccttccagtagttttgttaccttattgcctctcacaggaacaggtgatttcatatttctagctccaatagtgctctttcaaaacttgctgacatttcatctttttcccatttggccaagattggtggacacatttgttggccttagcacagcatttcataagttgtcagcagggagttaataggtgttacatggtcaaatgcgaaatgtggtattaaataatataaataccagtctctccactgtagaatttcttaggtcctttaatgtgctaatatgaattgagaatgtccaagaaaggaaataatatacaaaatctcccaaaacaattttaccagggaacccattttaggaagcagtgcttggccaggtgcggtggctcatgcttgtaatcccaacacttggggaggctgaggtgagcagatcacctgaggttaggagttcgagaccagcttggccatcatggcaaaaccctgtctctactaaaaatacaaaaactagccagacgtggtggcagacacctgtaatcccacctacttgggaggctcaggcaggagaatagcttaaatccaggaggcggaggttgcagtgagctgagatcacgccactgcactccagcctgggtgacagagcaagactccatctcaaaaaaaaaaaaaaaaaaaaaaagcactgcttaacacgtatatatccttccctgcccacaattatacatgttttgttggaaacatgagttgatacatggtattgctatgtttatttatttatttatttatttatttatttattttttagacagagtctcactctgtcacccaggctggggtgcagtggtgtggtctcggcccactgcaacttctgcctcccaggttcaagtgattctcctgcctcagcctcccgagtagctgggattacaggtgcgcaccaacacgcctggctaattatggtattgcaatgtaatggtatccacaatgtatgtgtgtagttaacttataatatgagcattgtagtaaactgtacagaatagagccaacctaacagacatgagactgctatctttagacaggcctgctggcaagattggcccttggctggtatgtgggaacttggtttccctctgttccctaaccggtaaatagttcagtttgcctggtttgttggtacaaataatgtgatttatcctgaacacatgttttcctcctcagagtctggaattttagtacgtgcctctgagaccagcccccagtgaaaaccatggtcactaagtctctaatgggctttcctgggtagaaatgtgtacacctgttgctgtatttttttgttgctggagaaaggatagggagagaacatatggaagtctgagcatgaatttctctagactcctgtcttttccctttgctgaccgtaatgtgtatctttcactgtaataaaccttagctatgaatacaactatatcttgagtccttggagacctggtgaatcactgaatgtgtgggtggtctgggagatcccaagacataataaaaatattgcatgtgttaggctgggcgtgtggctcatgcctgtactcccagcactttgggaggccaaggcaggcagatcacttgagctcaggagtttgagaccagcctgggcaatatgtcgaaaccccatctctacaaaacatacaaaaattagttgggcatggtggcacacgcctgtaatcacagctactcagaaggctgaggtgggaggattgcttgagtccaggagtgtgacagagccagaccctgtctaaaaaggtatatattgggccgggcgcggtggctcacacctgtaatcctagcactttgggaggccgaggcgggtggatcacgaggtcaggagattgagaccatcctggctaacacagtgaaaccccgtctctactaaaaatacaaaaacttagctgggcgtggtggcgggcacctgtagtcccagctacttgggaggctgaggcaggagaatggcatgaacccgggaggcggagcttgcagtgagctgagatcgcgccactgcactgcagcctgggcgacagagcaagattccatctcaaaaaaacatatatagtatatattatatatattatcttaatcctcagaacatctctgtaaggtagataaatattaatgtttgtcttttttaggtgaagagactgaggttagtgaggttaagtaacttcttttggatctcagttaataggtgagagaatccaaatctgtctgacttcaaagccttggcttttaactattatactgcattgcttcccaaaaccataaattttacctgtagtgggttgaggggaatgaatgatgatagtggtctgagaatgcttcacgcagaagataggatttgagttggtctcaaaggataaatgggctggccaggtgtgcagtggctcacgcctgtaatcccagcactttgggaggctggggcgggtggatcacctgaggtcaggagtttgagaccagcctgaccaacatggtgataccccatctctactaaaaatgcaaaggatagccgggtgtggtggtgcacacctgtaatcccagctactcgggaggctgaggcaggagaattgcctgaatctgggaagcggaggttgcagtgagccgagatcatgccattacactccaggctgggcaacaagagcaaaactccatctcaaaaaaaaaaaaaaaaaaaaagataaatgggcagaattgaaattaagggaagtggaaagagtattgtcaatagatagaatttcatgatattaaggcatgcaaacggtaaaaatgcaagatttgcaagaaagacatgtaactttcaaatagttgggtgaaatggaggatttacagtagaaagttttccttctgtacttaaaaaaatttggcagctgccacagcatgtttctgttagtgtttagtgtaagataatgaatctgatctaaaacaattatatatttaagcttaataagtgatacatgttagtttaaggataataaataaaataatgtacttgttctgcaaggacaaccatgatttcccaggtctttgccacctaaacaagtgggaaccctcatgctgttagcagtaaagaactgttgaagctttttttttttttaagcagcattttatctgaaaacagcatttcactcatattattttttacttatttattctttctgagacacggtcttgctctgttgcccaggctggagtgcagtggcaggatcttggctcactgcaatctccgcctcccaggttcaagcaattctcctgcctcagcctccaattagctgggattacaggtgtgcaccaccatccccagctaatttttgtatttttagtagagacagggtttaaccatgttggtcaggctggtgtcgaacttctgacctcatgtgatccagccacctcggcctcccaaagtgctgggattacaggcatgagccaccgtgcccagccttcactcatattaatctggtggtagtttgaagaatatattggctagagccaaggagtgagtccatttagatcactgcaatcatagtagtctatgcatgagataattaagagcttatagaatggtagaaatgaaagtggacaagagacattgtataggaggaatttcatgacgtagtgatggactggagatttgtgtattggtggggagatccaaaggatctgagtttgagtggtttggaaaaaaatgcagtatcttaaacagaagtatgacatttaagcaaatcgtcatgccaggattgtgataggtttgaccccaggtatattgacttgaattatttattttttaatttaatttttttagagacagggtctcactgtcacccaggtaggaatgcagtagcgtgatcatagttcaccataaccctgcactcctgggctcaatcaagcctcccaccttaacctcccaagtagctgggactactggtgtgtgccaccatgcccagcaaattttttttgagacgagatcctcctatgttgcccaggctggtcttgaactcctggcctcaagcaatcctcctgtgtcagcctcctaaagtactaggattacagatgggagtcaccatgcctggcctgaattgaataatttattaacatccaagtagaaaaatacatttgggaattggttgtgagattgtgattgaagagagaaatcaaggtataggataagagatagaaataatgcagtggagtgatcactgaaactgtctgaatataggcatcaccttggaggaaagaacaaaaaagaacatcaaggactgaactctggttttattcatttcatcaataagaaatgaatattaaagagcacatttgaagttaatatgttattactacctatcataaaccacgtttgcatagtacttattttaatgtgcattgattgggtattttctggcttgtgagctttgaattaagtggtcttttatattatgatatgaataacttttaaatgaaatcagtaaataaatgatcctgctttatgtaaagcatagatactgaataacattcaaatagcatttttttccttttcatatggcacattgttcttcataactttgtgtgtgtttgtgtgtgtatgtgtgtgtgtagttgttctttctgttgcctgcttaagagacacggtcttgctttgtcgcccaggctggagtgcagtggttgttgccctagtccctgtttcatttaaatacttgcttcagtttgttaattattttttcctccacttgttggctattgtgccactagttcagcagccttaatttactgccaattgagtatttaagataacttgttagaccagagttatacacaagaagagtcctaacattttatttcccttagtggagaaatgttcttttttcatttctcttctttttctccctcccacccagaaatgttcttttttttgttgtttgtttgtttggttggttggttggttggttggttggttggttggtttggttttgtgtgtgtgtgtgtgtggaatctcactctgtctcccaggctggagtgcagtagcgtgatctcggctcactgcagcctccaccacccaggttcaagcaattctcctgcctcagcctcctgagtagctgggattacaggcacccactaccatggccagctaattttgtatttttggtagagacggggtttcaccatgttggccaagctgctctcaaactcctgacctcaggtgatccacctaccttggcctcccagaatgattggattacaggcgtgagccactgtgccagccccagaaatgttcttaaattaatgacatttagacctaacctctctgcaacaaatgctttagaagctgaagggattgggcacaaaaatatttctaagagaagacggataggcaaaactgtgggcattgatacattcctgtttctggctatcttctctttttaattctacctgctgacattcttctaggttgagaacacagtctataaaagcttaggctctaaagtcttccccaactttgttgtgctctttgctccctcgctggaataagcagagaattagttgaatgtgcaaagggataacaagaagaaatgatacttttattatagactgacttttgtgtctcaggattttatgtcttagaaaaattgggattccaacaagttagtatgtcattttgatatatcatggttgccccaaattagtaaatgttgttttaaaactcttgtatatgtgaatgttctgattaattcattaaactcttcttatacaacactactgtgtttccctttgatatttaaggctgggtgcagtggctcacacctgtaatctcagcactttgggaggctgaggcaggcagatcacttgaggtcagaagtttgagaccagcctggcaacatggtgaaaccccatctctaccaaaaatacaaaaattagccgggcgtggtggtgtgcgccttgattccagctactcgggaggctgaggtgtgagaatcgcttgaacccaggaggcagaggttgtagtgagccaagatcgcgccactgcactccagcttgggtgacaaagcgagactctgtctcaaaaacaaacaaaaatatttaatcacctttgaatctaaattttcagtagcacagggttcatagaaaatcacagactatgcatatgcaatcattgagattgtcatgtttccctttattaagtaatatcttcttccatttcctactttattatatcagttggcatttattttattgtattattattattctttgagacagagtcttgctctgttgcccaggctggagtacaatggcgtgatctcggtacactgcaacctccgcctccctggttcaagcgattctcttgcctcaaccttccgagtagctgggattacaggcgcacacccccacgcctggctaatttttgtatttttagtagagacggggtttcatcatgttggccaggcaggtcttgaactcctgacctcaggtgatccgcccacctcagcagttggcatttatgatggagtacaacggaaagcccactgaactgacagtcaggatatctggattctagccccagcatatgacgccagttgttaatcttctgggtcccagttttactgtctataaaacagaatgacacttgtttatatcacaggcctgttataagtttcaaaaagtattaatatggaagcttcttgcattacctcttgcaattttttttgtattttttcatgattaaaagaagtaccataacacatgtataaggcatcttcacatgcttgttaaatccctggaactgttattgtgcttaaatttacaactgtatttcctaaaattaattttagaaccactctgtaagtttttggcttataattcagtcagaggaattggaactctatgaatatttcctgtaagaatgatatcataagcatgagtaatagtactcaattatcatgtaaagacttagtgtgatgttcagattaggaaagtatacttatggaattctctgtaattgatttctttcatttatttgaacatcttatgctccacaactcatgaggctcatcaaaccatctgtgtcttcatttctgctattctagatacacattcatctttttaaatcgtaaacagaaatatcggtaaaaaataaaatgagattctagttttctgaagcttcttaaaagtcagtatggtacattgaaaagatagagtgtctttgtctaggctttagagttccaggcctgtctctgctggtaattagttgcaagaacttgggcatgtcagtttacttattctgggccttgttttcccattataaaagtggcttgcactagacctttttttttttgtttttaacattatttgattcttttttaatctttaaagtatctatctgagggagctggtgaaaagattagagtttatactaatttttatgagtactatttattacccttgatttatacctaaggtaaccatataatttgctgtccaaacaagaggaaacttttttttttttttcttgagacggagtcttgctctgtcccaggctggagtgcaatggtgtgatctcagctcactgcaacctccgcctcccgggttcaagctattctcctgcctcagcctctcgagtagctgggattacaggcgtccaccaccatgcctggctaatttttgtatttttagtagagacagggtttcaccatgttggccaggctggtcttgaactcctgacctcgtgatccacccgcctcggcctcccaaagtgttgagattacaggtgtgagccactgcgcccagccaagaggaaacttttgagagtgaaagggagtactgttagcaattactccaggacaacagctttaaaccaggacgacgcaggtaaactagagtgtgtgttcaccctaattgcaccccatgtgtggctctgttaactgctttgttggccaaagagttatctgattatcagttttaattctttttcatggtttccctgttgttgttttttttgtcttatagatccactgtgtgtggagagtaatgcagcatcatgccaacagtctccagccagtaaaaaagggatgttcacagatgacttacacaagctggtggatgactggacaaaggaagcagtaggaaattctcttattaagccaagtttaaaccaacttaaacaaagtcaacacaaactagagacagaaaactggaataaagtatctgaagtaagttgtttatacccaattcactttgtttacaagaactaaaaccataaaaattgatgcgcttaggcctatagttacagtcactatgagagagtagtatgacttgataacatagagacttttatccttttttagattcattatgtctttgagcaaattatattttagaccatgagtcagtaaacttttggggggaaggagccagttagttaatattttaggcttttcaagctatactattacaactacttaactctgttatagtgcaaaagcagccatagagaatatgtaaccaaatgggcatggctttgttccattaaaaccttatttacaaaaagaggtggtgggctgtggtttgccgacccttgttttagactgttctatttttttaaaaaaatccagcaagtatcaaagaagaaagcgtctggaatgaaggttaattcagtccagtgtttcaagaagagtttgggttttaaggaaaagttttcctgtgtttcacgtcaatattcttagatctgataagttatttgttcattatgaaaaagaactttaaagttatttaaactggaatattataagaggtgttttaaagaaaagatgcctagttattgcatgtggccttagtcaggtgtacatgcaatgaagtgaagaaagatgcccacaatgcattctggagtaggaagaagtcaggcttacagaacagcacacatagtataatataatttatgcaaaattatatacattagatatgcatagagaaatatgaaaagccatgaaaaatatgctggatggtggaatttgggccttattctactttgtacatttctgtgtttttgtatttttaaagtaagtgacttttttttcaaaatgagtaaacctattaaaatggaatcagggcttataattttaaccctcttaattgaaagagatttatctctgtgtgttacatttgtgtacatgtattgtcatatgtgtacatgtatagtcatatagtttgttaaagaaataatgcatttattgttaatattgaataaaaattttcaaaatcctcgatttcccaagctagtgagcagtatatctccttgggagctctgtgtatttatcttacttgtggcaccaatttatacacagatagcatcaccattgtaaaaattggaagcctttagaggcaaatttcaagacataaatgcatttgtactgccagtgagagaacctctgagtactgtgtgaatggaggcttttgttgactagttggagggctgtttactggagtataatggaggatgtttggaggaagggtgagtagaaaatggtgtgtgaataaaagtaatgaacgtcatttaacagacttgggttccaatgtcagctcagtcacttactagttgtgtgactttagaaaagtcatttgatctatctgtgcctcagttttcatgtctttcaaacagaatacctgccttacaggattgctgtgaggattaaatgagataacacctataaagctgtacctttataggtgttacatagtaggtaccctatatctagtaactatttttgtatttgtaggttcagttggttatatcttttgtgtggcaagcccatctcactaatgctcttacattgtattgctctgtatccttactcagaaatacttgtttgcttaacagttatgtaccaagccctctgttagacatgggtttggtgagtaaaaacaagtatgatccctatcctcatggaatttatgctctgctaagacagctagttagacataacagaattgcatatacgaatataaaattgcaaccgtaataagaactacaaaagaaagatataggctataatacgggaaatttgacctagtaaaggaaagtcaaggaaagcttcactgagaaagtgatgattaagcagagatctgaaggatgagtaggtgttaactaggtgaaaagaggaaatgattccatgcggaaaggatcgcatacgcaaaagccctgtatgaggaaaggagcgtgaagggattgaaagtaggccagtttggctgaagtgaagagagcaaagaggagttagtgcacaatggatctaaggtagatggagtcttaaaagtggtaatgataaggaacttcatctgtattttttgttagtttgtttgtttttattttttttgagacggagtttcactcttgttgcccaggctggagtgcaatggcgcgatctctgctcactgcagcctatgcctcccaggttcaacaattctgctgcctcagcctcctgagtagccgagattacaggcgctcgcgaccatacctggctaatttttgagtttttagtagagacagggtttcaccatgttggccaggctggtcttgaactcctgacctcagctgatccacccgccttggcctcccaaagtgctgggattacaggcgtgagccaccgcgcccagccgtctgtatttgaagaaagataaatagccatttaagccctagggttgacatgatcagacttgttttttgaaaaaatgactctgactcaagcaagagaaaaggattatttattggaggtaagggtagatgttggcagaccagttaagagttagtcatggtaactcttaactggtctggaaaatgggagaagttgagttgaacagaagtgaacagattccaaaaaatgcttaagagattaaatggacaagatttggtgatggaatggatgtatggtgaaggggaggtattaaggctaggtttctggctcccataactggatgctattctagtgtaccaatcaccgagatgcggaatgtgagcagacagtgtgctttggtaggggaagatcacacatttgatttctaggcatttgtttctgagatgcctttgaaatatccaggagaaaatgtataacctctccaatttgtctttttttaaaaatcaggttatctataaactaataatgttcattatataatttaatcagtgcagaaaagtacaaaatttaaaatatcaccttcaaatcccaccacccagaaataattttcattaactttagataaacatcatgtcaaatatctttctatgtatgtatgcatggaaataactataaaaatgtaaggcagggcagttatgaagatggcattaattaaggtacataattatggttagcacacagaaaggtgctccaaaaatggtagtccctaatagtaacaataggaatagtatgccaaaaagactaggaaggaatattcatttgtgcagcagcaatagaaaaaaaaagaataggaaggaatatagactgataaaagtctataccaaataaactgatcttttgtttttatttttgtttttcttagaatactccgtctactatgggctacacatcaacatggatttcttctctgtcccaaatccgtggagctgtcccaacttccttgccacaaggactctcactcccttcatttcctgggccattatcatcatatggaatgcctcacgtttgtcagtataatgctgtggcgggggcggggtatccagtacagtgggtaggaatttcaggaacaacacaacaatctgtagtaattcccgcccaatctgggggaccattccagccagggatgaatatgcaggcatttccaacttcatcagtgcagaatcctgccacaatccctcctggtcctaaatgaatcagagtagatggtgataaaaagggaggttttttcagaattattttcaggacacccaagatattaaagtttcttcctcttgggttctgtcatattttccctcatttgagtttactttagactatatattttttgttccagtgtggtatttgatacagctcatcattctgtagaaatgtgcagtttgcagatagaacactgcacacagaaatgttttttcacttcaaattctatcctctttgatacttgattttttaaaaatactgttcagaatgctttaataagctcagcttgagcattaccatttccaggacactttccatgaattgttgagaagctccccatcccccgccttttttttttttttttttaactgctgctatctgcagctggatactcttctttaaaaatgtttaaaaattatttagattgattctccccaaatgtggatgaactgagaccctccatcagccagagtcttatgggatcttcacttcacatgtttgtcttaggtttacctttcacagaaggcagggtaacttgctgcaggaaacgttttggtgtataaaattagaatcacttttttttttttttttgagatggagtctctctctgtcacccaggttggagtgcagtggtgtgatcttggctcactgctgcaacctccccctcctgggttcaagcgattctcctgcctcagcctcctgagtagctgggactacaggcgccagccaccatgcctggctaatttttgtatttttagtagaggatggggtttcactatgttggccagactggtctcaaactcctaaccttgtgatccgccctccttagcccccccaaaaaattacaataattttgtcaaccaatacagaacatgagccctttttaaatgtgatttcccgtcatcacagcagtaggatgaagccttgttttgggtgagacagagggaaagggaaaaaacagaattgtaacagttccttgattctgcagatactgctgctgttttacgatttcagtaataattcaaagcagctgtctccttgtttctcacatgcatactacattggttttgagcatctgagaggcattggtttgtcttgcattcttttgcaaggcatatattgcagctgatatgaatctcgtttggggggaatccttgtattcctaacaagggggattaaagctacacctcaatccattcttctgaagtgaaatttacttgacacagtaggtttcgagacttacatatgaaacactggctttacagggttctcagagatgtggggtatacactgtcctgcagtgagatagtagaccctagaaggatactatttaagttgtccttagctctttttaattacaatttttagttgttagaatttctttttagtatctatagtatcttagatgattttagatcttaaatgagtttggcagcctctttagaatctgagagagatcactgtcaagttgcactttactgggttttatccagttttaggaggaggggaggcaatgtcaaaatgtacacctttggtttttaagaaggttaactataataatgttaaaggctagtcacagggttacctaatgctcagtctgtgaaacctaaatagaattcttaaaatgttatttaccaactaagtattcatgttcaaattacttaccttccactctgaagactttaaggtcatttctaatacacatttacctaattaggagttctgtctactagtaaacattccaaattgctacccaacattactgttaacagattttcctccgtattcttctaaaaattataccccatgggcttgccaggtaatgacgaaaacttaatgggtgtacttttttttttttttgcacagtctactttgtgacattaagtacctcttttccaaaaaaaaaaaaaaatgtgttttatgttgcttacctgaggatcacatccattatcaagaagattctgtcgctataatttgaggcatctagggcagcattttgagaattgctgttgataagatccactgtttcttttcatagaacatgatctgttttgtatgagtctttccaaatgttaagtacagattcttcaaatttcttgtacagtattggtttgcagtttaaagtgattttaggacattagtgtaatgcaaatgcttgcattgcactgttttccatatgtataaaaacaatgctcctaaaatccctaattctttaaaactgcctgtgtttcattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgca

SEQ ID NO: 3422 - DNA, 50712 bp, human
cagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgcccccggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaaaaaaaaaaaaaaaaagaaagacggtggattgatccaaggttgagattttgccaggtgtgtgtggcgggagaacaagggaaggaaggagtagaaggtgctgagagagaaaggtggaagaggtgggccttgggagtcaggctagaggagaaggctggaggggctgataggtagggagacagcagaaaagccaacagaggcagaagccagttgtagcaggagctggagagctgcaggtccacgaggttggttgtgatgtgaaatcaggatggtttcttggatttgaaaaggtggagcagctttaagtcaggctgaggccacagaccactgcctttgtgctacacagacctgagtgtctgaggagcacagcaggaccttccccatctggggacattctcatacgggcctgagcccaggagccacagaagaagagcagcgcacatctgccctgccttccactgggactgaaggagttgttaagcccttgggggctcccgggttcacacctcaggctccacagatctctgggaccgtggccttgcaccaggtagcagtagtgaagtataaagcatgggtaggatgtgccttttggtgccttcatgaccttgggctagtcatggaacctctgggagatttcagggggctccctcagtgtgggctgaagataaccagctggcaacaggcccttaacaccttggcctgcatgttacttctgctggctttccaaactccccttgacactgtgtaaagccagtgcctttttgcagctgccaaaacaggccacaagcactcccaccccaggacttttgcattggcttttccttctggctggaagctcttcccctagccctccacctggcttgctcctcgtcttgcatgtctcaggtcaaatgtcacctcttccaagagactgtccctaaccactttaggtagggccacttgtgagtctccatcagagactgtgagtgtgcttccatctttgcacttagtacaatctgaaattatcttattgtatgtgtctactcgtttattgcctatcttcctctactagaatgtgagctccatgggggcaaggcgattatatctcttttgctcactgttgtatccccagcaactagcgcagtgcctaacacgcagtaggtgttcaagaaatcctcattaaataaatgcctaaacagatactaaagaagcacatagtaggccctcagtaactattgcctaaaagaaggacaccaaattcctgccctctggatactcttgatctgaaagtcagtagctgggcaatgtctagacccccagtctctggcctctgtaatcaatacaaggtgatgattctgagtatgccttcccaatccaccaattcattcaaattacaaatcataatacccttcctaaaccactctcctcctccccaaaaaggcaacacagagttcccaggatccttttccccaacgaagtccttgcctctgtaattgcatagtgggtgtcttttttttttttttttttgattcaagatggggattaggaataagacaagtgtcagggaaggacctggcctcctattctaactaattcactttgtgaccctgggtgagtgacttttcttctctgaacctcagtttcttcatctagagaatgcaatgaggagtctatgaattaatggttgtaaagcctgcagcatggtataaatcctcagcaaccaggagtttaaaaaaataaaattaagttaaaaaataagagaaaaaccttctgaagaagaggcggaggaattactcaggccctgactaggcgggcgccgggccatgtgattcactgcagcatgggttgtgagaggccacctcccccactgcccagccggcccaggggtaggcacaagtgacttggcttctctctccatgggactcgcctataattggccctaagagggcagggttagtggttgtagggtgtgtgtgtaagagagagacagagagggtttcctgagcttcaattaaagggctgaaacatgctggtccacatgttaagatttctgtgtgcctgctgacttcctccctaacactgctgagacctttattgaatcaccatctttagggctcagtggctcatcctgggggtggggggaggcttttaaaaataataattgtatcttagccatgtgaacagccttgaattgcttcaaagtgctttctcttttagtgatcctgtctgcttcctggtggggaaaggtacagttgttattatgcccattttccaggttgattaaaccgaagtccttgttggatcactgggaaaacccagtgaaatgccagagaggggtttgagagagtcagaaagcggtttgcttgcaggggtttgcagagatggttgctctattcctcagggttgaggcctagaatgtcctttcagatgcagggattgtggggatattggtgtctgaccctagctaagtcaaaggagttgcacctgatgttagagccgttttgtgggtaatgggggaaactgagccagttgaggggggcaaggggaggggctgactctttctcatttggatcctgaggcatcttcagagtctccaagagtaagaattggagctagaaaagactctagatactgcctcgttctgagtttccctaactgagtgagcatcagaatctcttgttgaccttaaaaaaaaatgtgattccacactccacctcagagtgccagaatcttggggttgacaaccaaggaacctattttcaaaagctccttaggtgattgtgatgcacagcctagagtgggaaccactagttaagtccgttttccagatgggacagtgaggaaggctcagagaggtagtgatttttttagccatcatcctacagtgagtcagcatcattagggccaggagaatacatcggcctccccatctaaggccctttccccagggccccatgtgggcttctgtcaactcactcccaaccgcaaatggaggcatgggattaaacacaaagggagagtcaacctcctgccctcatacacacaaacactggctgcctcagtttacccttattctcagctctcgtgaatggctaccatttggcagttcaaattggaaggcagttgccattctgggactctaggcagaggaaaccctggcatcatcagtgcccagtgcaggatctggccctaaggaagggttctagaggggtgtcaataaagggttgtagagctagagaagaacatggaggacaattcaggtaagaggttcagtggaagcaaaggcagcgagacatggggcactggggaatagggctggtattgggaggagtggagtgacaaggctgacaaggaactttcttctgagggtgaagagaaaccatcgaagggtttattaacgagaatgacatgctcagacggggtgtttggaaactctccctagctgcatggggagaatggatggaaggggtgcaagagtggaagcagggagacaggcaggtgagtgttgcagttttcccagagagaggtgatagcttgagttagagcgatgggaggtaaggagggtaagatctgagagatatttagatgctagcatggacaggccttggtagtagcttggatgtagaggctgagacagaaggcaaagtccagattgctccatgttgttttctgaaaccaactacagtgacctggtggatgttggtggggccatctatatacaagagagggaggaggtttgagggaagatagtgaattatgtttgagacaagttgaattcgaaacgcctgggggtacatgcaggtgaagatggccagcaggcatttgtgggtttggttcatttttgttttttactacccaggatgatcacttttaatattttggtctgttttctgctagatctttttctacatattgacgtatattttacataattgaaatcatactatatgttcaactttatatcatgctttttcatttaatatatgtatttttccaatatcattaaaaactcttcatgaacattttattttttttgaacaacattttaatgactgcataataatatgccattgtatggatttaccataatctttttttaaacttttattttaggttcaggggtacatgtgcaagtttgttatatgggtaaactgcatgtcagggggatttggtatacagattatttcaccacccaggtaataagcatagtacccgataggtagtttttcgatccttaccctcctccctccctccaccctcaaataggctccggtgtctgctttttgtttctttgtgtccatatgtactcaatgtttagctcccatttataagtgagaacatgcagtatttggttttctgttcctgccttagtttgctaaggataatggcctctagctccatccatgtttctgcaaaggacgtgatctcattcttttttatggctgcatagtattccatggtgtatacataacacattttctttgtccagtctactattgatgggcatttgggttaattccatgtcttcgatattgtgaatagcactgtgatgaacatacatatgcatgtgtctttatggtagaacgatttatacttctttgagtgtatacccaataatgagattactgagttgaatggtaattctgcttgagttatttgagaaatcaccaaactgctttccacaatggctgaactaatttatattcccaccagtagtgtataagcatttccttttctctgcaacctggcatgttattttttgactttttagtaatagccattccgactggtgtgaaatggtatctcattgtggttttgatttgcatttctctaatgattagtgatgttgagcattttttctttttttttttctctgtcacccaggctggagtgcagtggctctatctcagttcactgcaacctccgcctcccaggttgaagcaattctcccacctcagcctcccaagtagctgagattacaggtgcttggtggcaccacacccagctgatctttgtatttttagtagagacggggttttgccatgttggccaggctggtctcgaactcctgacctgaggtgatccaaccgcctcggcctcccaaaatgctaggattataggcgtgagccaccacgcctggctgatgttgagcatttttttcatatgcttatcggccacatgtatgtcttcttttgaaaagtgtctgttcaagtcctttgcccactttttaatggggttgtttattgcttgttgatttaagttccttacagattctggatattggacctttgtcagattcatagtttgcaaatattttctcccattctgtaggttgtttactctgttgatagtttcttttgctgtgcagaagttctttcatttaattaggtcccatttgtcaatttttgtttttgttgtaattgcttttagtgccttcattatgaaatctttgccaggtcctatgtccaaaatggtatttcctaggttgtcttccagggtttttatagttttgggttttacatttaagtctttaatccatcttgagttgattttagtatatggtgtaaggaaggggtccagtttcagtcttctgcatgtggctagccagttatctcagcaccatttattgactagggagtcctttccctattgcttcttttgtcaactctgtcagaggttagatggttgtaggtgtgcggccttatttctgggctctctattctgttccattggtctgtgtatctgtttttgtccagtaccatgctgttttggttactgtagccctgtaagtatagtttaaagtcggtagtgtgatgcctctggttttgttttttgttgttgttttgttgttgttgttgagatggagtctcgctctgtcacccaggctggagtgcagtggcgtgatcttggctcactgcaagctccgcctcccgggttcaagcaattctcctgcctcagtctcccaagtagctgggactacaggcacccgccatcacgcctggctaattttttgtatttttagtagagacggggtttcaccgtgttagccagggtggtgttgatctcctgacctcgtgatccacccgcctcggcctcccaaagtgctgggattacaggcgtgagccaccgcacctggccttttttttttttttttttttttttttttttttttgagactgagtctcgctctgtagcccaggctgaagtgcagtggcatgatctcggctcactgcaacctcctcctcccgggtcctggttcaagcaattctcctgcctcagcctctcgagtagctgggattacaggcacacgccactgtgcccagctaatttttgtatttttagtagagatggggtttcgccacgttggccaggctggtcttgaactcctgacctcgtgatctgcccgcctcggcctcccaaagtgctaggattacaggcgtgagccaccgtggtttggtttttttgtttgtttgtttgtttggttggttttttcagacggcgtgtcactctgtcgcccaggctggagtgcagtggcatgatctcggctcactgcaacctctgcctcctgggctcaagtgattctcctgtctcagcctcctgagtagctgggattacaggcgcccgccaccatgcttggctaatttttgtatttttagtagagacatggtttctccatgttggccagactggtctcgaactcctgacctcaggtgatccgcctgcctcggcctcccaaagtgctgggattataagcttgagccaccatgcccagctggctttgttctttttacttaggattgccttggctatttggacacttttggttctatattaatttttaaatagttttttaaaattctgtgaagaatgtcattggtagtttgataggaatagcattgaatctgtaaattgctttgggcagtatggccatttgaacaatattgagtcttcctatccatgagcatggaatgttttcccatttgtttgtgtcatctcgcaagcaggcatttggacgtaagattggaaagttcaggaaagaggcctgggccagtgatgtttgggagttttcaccaccaacacataccatgtatagatctgggagccagtcccatccttgaagacagacagtaaggttggcagggtcacactcagatgaattattcagtacctgctgtaactttgccatagaaatgccttttttcaggggaaagcagtttttaaagtatattttcatgaagctgagacccagccgtttttaaggcatatttgagggctgggcacggtggctcacacctgtaatctcagctgctcaggacgctgaggcacgagaatcacttgaccccgggaggcagaggttgcagtgagccaaaattgcaccactgcactccagcctgggtgacagagcaagactgtggttttgttgttgttgttgttttctttgtttttgctttttgacggagtcttgctctgtcgcccaggctggagtgcagtggcaatctcggctcactgcaacctccacctcccaggtccccgttcaagcaattctcctgcctcagtcttcccagtagctgggattacaggcgcacaccaccatgcccagctaatttttgtattttaagtagggaaagagtttcaccatgttggccaggctggtcttgaactcctgaccttgtgatccgcccgccttggcctcccaaagtgctgagattacaagcatgagccaccatgccaggccaagactgtgtcttaaaaaataaaatcgaccgggcacggtggcacacgccagtaatcccagcactttgggaggccaaggcgggtggatcacttgaggccaggagtttgaaaccagcctggctaacatggcgtaatgttgtctctactaaaaatacagaaatcagccaggcgcagtggctcatgcctgtaatcccagcactttgggaggccaaggtgggtggatcacaaggtcaagagatcgagaccatcctggccaacatggtgaaaacctgtctctactaaaaatacaaaattagctgggcgtggtggcgcatgcctgtagtcccagctactcgggaggctgaggcaggagaatcacttgaacccgggaggtggaggttgctgtgagccaagatcgtgccactgcactccagcctggtgacagagcgagactccgtctctaagaaaaaaaaaatcatccaggtatggtggcacatgcccataatcccagctactcaggaggctgaggcaggagaattgcttgaacccaggaggcagaggttgcagtgagtcgagattgtgccactgcgctccagcctgggtgacagagcgagactctgtctcaaaaaaataaaataaataaaataaagcatatttgccgggcacggtggctcacgcctgtaatcccagcactttgggaggccgaggtgggtggatcacaaggtcaagagattgagaccatcctggccaacatggtgaaaccctgtctctactaaaaatacaaaaattagccaggcgtggtggcgcacgcctgtagtcccagctactcgggagactgaggcaggagaattgcttgaacccaggaggtggaagttgcagtgagccgagatcttgccactgcactccagtctggcaacagagcgagactccatctcaaaaaaaaaaaaagcatatttgaagccagtcatggtgcctcacacctgtaatcctagcactttcggaggctgataggggaggattgcttaagggcaggagttcatgaccagcctgggctacatagtgagaccccgtctctacaaaaaatatttttaaattagcagggcatggtggtgtatgcctgtagtcacagctacttgagaggctgaggtggaaggatcacttgtgtccaggagttcgaggctgcagtgaagtatgattgtgccactgcactccagcctgggtgacaaagtgagactctgtctcaaaaaataataaataaataaacatatttgcatgaagctgagacccatttcacgtacacccagggtagctggctattgcaaagtattgagggaggagtacttctgaaaagcaaatcaaacattggtaaagtaaatttgtgtggttcccagtgttctctctgttgagggcatcctgagaggccagtgagggggtttgcttacggaaaggagaagagagggcttgggacaggaggggatcgtggggtctgctggggagttttggagagaagtagtttgagattccaggggagagtctggggaaagaaccaaatttggttcctagtccactagggccttccaaacaaacacaacaaaatgtaaagactctgggtagctgggaaaaggacttccccagacaagactaaaagaatagaagcttctaaattgcagatggctggcagtccgctcttggccctttcaggcccctctgtccctgggggagggcccaggtggggctgcctgcttcctcaagggagagtggagtggcagctaacaatgccccacacaaacccaagccatggctttctgggggccagttagctaaatgccttaggcagatgtggagctggccagacgctggctgggtggggctaggacctgtctggaatgagggcaggaaatgcagtctgccattggctagcaccacagagttcagttccctcatctggagagagcaaacatctttggagcaatgagtccagcctctctgggctctggtgcccagttccttggacctagaaggtgtgacacctccaaacggtgtctgaaaacacacacagctcctgagacaaggctgcagggcatagccgggggagcctcagcactcctagctctgctattggttcactgttcctccaggcctcccttcccctctcagggtcttagtttccctatttgtaataccacaaacctggtcattgtggcatcaataaataatacttggtgagcaaatagggtacaggggaagggagagtgaaagaggggagcaaggggggcatttctttatttaacatgtacctgttgagtgcctactatgtgctaggccctgtgcttaggtgccaggtaggcaacaagacagtcactatccctgtcctcgtggagctgatatctagcaggaaagacacactacaagcaattccaagtgcagatgctgcaagaacacatgagggtggggggagtgggcggacagggcaaaggagatatttgagttgagacctgaaggataaataggagtccagaggtagggagaggcagactagcagttcgggtcacgggaacaacatgtgccaaagccctaggcggaagagagcactttcgaggaacagacaaacggccattgtggctggatcgtggggcggggaaatgttcctgagctaggccttccttgtccctgtgctcaggagtttcacccctgaaggcaaagggagcccttcacaaggctgaagggattgcaggggactgtgttttccaaaagctggcagtggtgtagagaatgcctcgtagaggcccggaagatgggagtgaaatcagttagggggctggagggggaatgaagcatagggattctagagcaactgaccatggtgcatctaaaggacttggggcctggctggacatgtgggttgagggagaggaataaacctaggacttgggcttgggcagctgggcggatggagttgtccttcctgcgatggggaaggcaggaggagaagcagaccggggctggggtaggagtgtcgttcacgatgtgctgaggctgaggagcctgaagacaggacatctaggtgacagcacccagttggcatcagatatgcctatctgggtcccagagtaagggcaggtgggtgaggggcacaggtatgtagctgagactaagagggaagagccctccttggcgcttccccatggcccctgcagggaaagggttaaatcgcggagggaaggcgcctgtggaaagcgggaaaggcgggactggcagggctggcctttgggagctgcagctggcatagaagcccttccgcccgccagggcctgctaggcctgggccgccaccgcccacaccaccgcctttgccttcgcctttgcctttgccttccctgctccccctccagccccttccctgctcccctaggctgggggacccccctacctaatgcattccaggtgtagacgcagcccctcccccaccgcgcgggtgtgggaggggcagggaaggctggggtcactttcaccgcatctcttagggagcatctcccaggcttgctgactgcttctctctctctggagaattccctcagggatctctgtttgggcctccctgactctggcaggggctggcagcagagagagccccccagacccaggtccgccactttctaaagtgtcacgtgaccttgggcaagtcatctcacccctctgagcctcggttttctcatctggaaaatggggctgtcattcccaccttctagggttgttgtaaggattcaatgccacagatccatccccagcccttggcatggcacattgtcaccatgttcaacagatggccctggcctgccctttttgttcctgcccctctgcctgggtctgtatccctcgctgactaccatgccctgtgtggacctttctgtctctgtctcccttctgacttgtcccttccttttgtccatctccctctatgtccatctctgggtctctgtggttttcctgtcctctccctccttgtgtttgtcccagtgtctttctcttatcatctgtcttttcccctcataatccttctgtgtctccaactctcagatttggccaggcctctggtgaatgggaagggagatgggtgggtgttggggtccctggggttgaggcaagggtcagagggaccatccccctagcggctttgcctcacaggaaggggaatctcagccagcgtggcagccccagcatctggtaattactgctcccagtgctcccagctgcagttccactcccttcccttcctgtcctctgaagtccccagctcctcccggggcgggggagggagatgggcgggggtggagctaccgccccctatcctctggcctctagtccagagaagcagggaggaggtggccaggccctcacagtaatcaaggaactggaagagggatgggctgcttgtgctctcatgtggctgcttggtttgtctgtgtgtgtgtgtgtgtgtgtgtgtgtgtgtgcgcgcgtgtgcgcgcgcatgtgcctggccttctttgtccccgtggatctattttgtgtgtgtgtcttaatgttcttgtttctgtatggccatctgtatgtttgcatatagatccatgtgtgtctctgggtctgtatgtgttacgtgctcctctgtgcctggttgtatgtcaccttggccctaagtatgtgggagtttctagatgtttctgcgcatgggtctccttagatcttgtggatgtgtctgtctgtttctatacctgtgtctgttcccgtgcctgcgtctgcctctgcatgccccctataggtctatggttgtggtgtagggaagggggtgtctgcttgcttgtatcttttggcctttcctgatccttcttcctgctgtggagccttcttgcaaacccatgacattacgtacttcaaatatatgcttcactcatacctccccacccaatatccacacttttgcccactcttcttcccttgtctgcagaaccattctcagtccatctatacctaaaaaaaacacaccccatcctggatggtgcaactaaaaaccacctcctttaggaagtcttctctcctcccccctccaaatgtgatttctttcccaactcagcagtcactgaaggtgtgctctgtgactctggacacagacacacctgggatctggtcccagctcaaccacttttagctgtcctcaggcaaattattttgcctctttgtgcatcagtttcctcatctgtaaaatgggtaatagctcaccggatcattaggaggatgccatacgagatagcatcaacacaacacctggcccagagtgggtgttcagcagttgaatcctcatatcttatatcctctactaaaaagtgaacagcttgagttccagagatttctgcatattcttacaatctcctgctctctcttctttaggcatcctgcacagggcagaaggtaaatcgggtcacacagaacaaaaggcagattccaattcagggaacttctgacaagtaatgcatgggccagctccctgagcctgctcagacacagaggaaactgggcccttccagggagtgggagataggacctgcaaggcttctactcaagggcaagagcatgtgagatagggcaaggcataaacagcaggagtagaatgagccttcaggatcatctaactcagatagtgcaacatgatggcccacaagttgaatttgactcacaagtttcatttggcttgcccacagtttttaaaattaagggacttcacatgaaaaacctggatttcccggccgggcacagtggctcatgcctgtaatcccagcattttgggaggccgaggcgggtgaatcacctgaggtcaggagttcaagaccagcctggccaacgtggtgaaacctcgtttctactaaaaatccaaaaattaggcagatgtagtggcgtgtgcctgtaatcccagctactcgggaggctgaggctggagaatcgcttgaactcgggagacagaggtagcactgagctgagattgcgccactgcactccagcctgggcgacagagtaacactctgtctaaaaaaaaaaaaagaagaaaaatctggatttctggattcccttgaaatattggaagacctgacaatacagcgccacattactgcaagatgacacctgggtggaggggagaagctgctgcttctacttcaggttaggcatgtgctttccagtttaacccagtccccaccattccccatggccttagactgtcccactctacagaaagttcctcactttatactagggtctgcactttacagaaacatccttctctttacagaaggggcctcactttacaaaaaggagttctcctttttaacagtcttctgttttgtcatgatccttaagagtcctttggttacaaacaggccatccattttacaaaagggcctttagagaactctcctcactttacagcatgtccctccactttgaagaaggctcctctttttggaaaaacttcttccctttacagaagggccttctgtttatcaaagagatctccatttcacagaaagtgtctccgttttgaaggatggaacactcttcaggaaactcgaaagagttaggaagctcctgacttgccagaatggcccccacttcttgaaagtgtcttcacactatagaaagtgcctccatttttctgcagagtccttatgttgagaagaatagtcgacttcagggaaggaacccctgagctacccacagggttcctgtaaacagctccttctgcacatttcacacttgaccgagctttgtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccggaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggggccctagtagctgtcttgagattaagccaaggctacagctgggagaagtgagaggggctgctactagctgggagggggaaaacttggcagctgagattcccaggaagggttgagggagatgcagggtccagttccagtgggaatgggcaaaaggagcccttgtcctcagacacagctagatgctggactttctctgccagtaaacccagaagcatgtgctcagggcacctgccacgcaggggcatgcagcaaccagaaacaatttttgcaaggattttcctatttcaataataataaattgtcatgggaaaattcaaacctcagctacacttcttgacacttattttacagtttttttctggtttgtattttgaattgaatttgaatggggaggacagggcaccattgtcttcactgccctaccacctcgcataggaatcctgccctgatctgcagagctatcctggtgagtggggctaggttctgtgtctctcactggctgagtttgcttgtgtttctcagtgtatatacagttttacgttgggttgcagcctacagcccgtgggcttatgtatttatgtgtgtagttttgtggctttgtggatgtgtgattctgttggttttcaaatttaacccatatcactctgtgtgtgtggtggggtgggggtgggtcactgtgctctttcccttccttgtcccataggctcccccaaaccaaggaactgctattattgtccttctttccagataaagaaactgaggctcaggtagatggggagacttgcccagggccacacagctagtaaaaggtagtgttgtgatctaaactgaggtctgtgcaagtcctaagccagctgttcctaatacaggtgctgcagcagttcaatccgtgcagttcagtcagtgatcatgatgacaccacccttgttgggaatagtcaagtatcatagttttataaattagtgacttaagaaaaaaaaaaagaccagattcaaggccatccctgaaataatggcactgtcgtgagcattcagatgcccatggcagaaaaaattgggtagagtccctagcctgcttgaggcttaagtggacaagagtctgggggaactctggctaccaggtgctgtcttgaaggcccggctctgccacattcatttggaagctttccctgactagcgttgccagaattagccttcagaaagtatttaatacaattagatttgaatttcagatatacaataagtcattttgtttttagacggggtatcactctgtcgcccaggctggggtgcagtggcatgatttcggcccactgcagcctccgcctcccgggttcaagccattctcctgcctcagcctcccgagtagctgagattacaggcgcctgccaccatgcccagctaatttttgtatttttagtagagacggtgtttcgccatgttggtcaggctggtctcgaactcctgacctcatgatctacccacctcggcctcctaaagtgctgggattacaggcatgagccactgcgcctggcccaacaagtcattttttaagtatagcttaagaaattgttagtataagtattcatgagacatattatactaaaacattccttgtttatctaaaattcaaatttaactgagtggccgggcatggtggcttacgcctgtaatcacagcaccttgggaggctgaggcaggtggatcacctgaggtcgggagatcgagaccagcctggctaacatggtgaaaccccatctctacaaaaatacaaaaattagctgggcttggtggcaggcacctgtaatctcagctattcgggaagctgaggcaggagaattgcttgaacccaggagtcggaggttgcagtgagctgagatcgcaccattgtactccagcctaggtaacaagagcgaaagtccatctcaaaaaaaaaaaaattaactgagtgtcctgtattttatctggccaccctatccattctcctccactgagcttccccagtccccacaggctcgccctcgttgcctttcctgagttagagtctttgtctttgagattgggagctccctgagggtaagggtcaagattgcccttctggcctgctgaatgcctgggggggcaggggtttgagagtggggcaggaagggtgcataccccacccccatccccacagcagagctggcacagtgcactggcactcctggggtgcctagagtatgctttcctaggtgacaagagatgtccgagtggcagtggtggttgtgtgtgtgcagttgtgccgagcacggtgcacacagacatgagtagctctgtggttctctctctgggtctttgagggatgtgcacagttggtgtgtggctgggtacatttccacaaagtgttatcagatttggtggtggctgggtgtggtggtacacacctgtagtcccagctacttgggaggctgagacaggaggattgcttgagcccaggaattcgacaccagcctgggcaaaatagtaaggcctcacctcaaaaataaaaaataagaaagatttggtggtgtgaccaaatgtgtgtgacgggggctttttggtgatctctgctctactgggcattggggaattataaatccgttgatggaaggggcagtgctggtggaggatcttgtcaggtgtggaggtgtgggtgtgggtgtgataatgttgtggattatcaaccacaagaaaaatgggctggaattgggcacactggctcatgcctgtaatctcagcacttttggaggcagaggcaggaggatctcttgaagccaggagtttgacaccagcctgggcaacaaagaaggaccccatctctacaaaaaaaattaaaaatagccagccatggtagtgagtacctgtagtcccagctacttgggaggctgagatgggaggatcacttgagcccaggaatttgaggttacagtgacctgatcacactactgtacttaaccctaagcaacagagcaataccctgtcttaaaaaaaaaaaaaagggctggagaaaatgaatccaggaccttgctgggtagggacgggatggggcagtgggaatggctgtggtttctaggaaggaggaggggggcctaccctgggagctccccaagggcagggatgggattttctcatctccaagcacagggtctactaggttcaaaaatattctggagaccaaactcagccaaggaaagccatagagttcagcatggtcatgaggggccactgagagctagctgagaagtttctttttttggtgtttttgtttgtttgtttgtttgtttgtttttgagacagagtttcgctcttgttgcccaggctggagtgcaatggtgcgatctcagcttaccacaacctccgtctcctgggttcaagcgattctcctgcctcagcctcccggtagctggtattacaggcatgcgccaccacgcccagctaattttgtatttttagtagagatcgggtttctccatgttggtcaggctggtctcgaactcccaacctcaggtgatccacccacctcagcctcccaaagtattggaataaaggcgtgagccaccgcgcccggcctagctgagaagtttctattttcccatggacagtagggagttacagaaggttcttgtgcaggtaagtggcatgatctgagctggactgtacgtaagttcattcagccacctggagggagcaagacttggagccaaggaggccactgagggaaaataggagacagggaaatgtaggcagagagacaagggagagggagttctgaaacgagagggagggatcttgaaccttctcccgctcagtgaaacctagcctggttcttggccaggcctaggctcctaaactggacccctgttcaactccctgtggacagggttgaggggtgtccctctgactagctacactgcagtttgtgactttcggaagccgttgggtccacccgcccctcctggttcccctcttttccagcttgcccttggagagcagggttaataagaaaggaatccagtccatgaccagtctgcccaaaagtgtgccattcattgatttgctctgtgaccttgggcaagtcactgcctctctctctgactccatctcctcactagaaactgggctgacaatctcttttcctctcacctgggactccagggaatctttgcatttcattcagcctcctcttcctgcagggctgcctgcaaggaggcagagagaatggagaggcaggtctgtctgtgggctgtcaggtgagatgggtgaggagggagcaatgggtgggctagggcagggccatggaaagtgggatgtatggtcactccatcccgaggaccagcactggaggagaaggagagcagcattatccagggaccctgctgctttgctacagatagggtagggagggcttgcccagagaggcctgcctgctttgaggtgtggagataggtgggctcctccaggcccaaggaggcagacaaggggcaccagggaccctggcacctatgtgtgtatatctgaggaggggtctctgcatggcagggtgcctggctttactcactgcctctctggccctgtcagctcctctctgtctctctcccttgctctggccatgtgtctctccaaccacatctccgcctgtgccaccctccaggtgattcatcttcctcacccccacgcccagggggagggcagggcaagaccaggccaggatgtgctgagcagggcagggtaagcggcacagctgagtggagaggagcgcctcctccatcctggccaggccctgccagcttaggtggggaaggaagtgaggaacgacacccaaagcaaggtacagagttggggaggggcgctcggcctggggcctggggcaccctgttccctcagtgctgggaaaggaccctgatctgagtcccctggggtggacctggctgggatgtagccaggggtgaggtcaggggcctagggaagctgctggaaccctgtgggttgggctatttcttccctccgggactgggagacctaaaatcccctgtgactctttctgcctgtgtgaccctggaagggaggctgcagaggtctttgtgtgtgtatgttttcacagcagagtttgtatgtgactatttaggaggaggcaagtgtcccacagtgtgtgtattcctgggcctatggctaagacccagggacaccgtggatgtgtttgttagatgagtatgacatagtaaatgacagttgtcccttggtctccatggggaattggttccaggacagcctgaagataccaaagtcgccaacactcaagtcccttatataaaatggcatgttgtttgcatataaactatgtgtatcttcctgtatatatatatatattttttttttgagatggagtctctgtcgcccaggctggagtgcagtggcatgatcttggctcaccgcaacctccacctccctggttctagcgattctcctgcctcagcctcccgagtagctgggattacaggcatccaccaccacacccagctaatttttgtatttttgtagagacagagttttgccatgttggtcaggctggtctcgaactactgacctcaagtgaaccgcccgccttggcctcccaaagtgctgggatcacaggcgtcagccaccgcacctgacccttcctgtatactttaaatcatcgccagattacttataatacctaatacaatgtaaatgctatgtaaatagttgttatactgtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatgaccatcatctcctctagagccaaagatagaggtggctttaggggacatacagtgagggaagagggacagtataaaaaggcctcccctttttctgaactggctgcttgatttaaagttattcctgtgacctgaactctggatgttgcacgtgtgtgtgtggcagaggtggaagatgcatgtgggtctgtgtagatgtggaagttgaggaaggtagtacagattgctgagaagttgggattttctttttcatttttcttcttttttttttttttcttgagacagcgtcttgctcttttgtccaggctggagtgcagtggggtgatctcagctccctgcaacctccacctcccaggctcaagtgatcctcccacctcagcctcccaagtatctgggaatacaggtgcacaccacactgcccagctaacttttatattttttgtagagacagggtctcactttgttgcccaaactcatctcaaattcctgagctcaagcaatcctcccttctcagcttcccaaaatgctgggattacaggcatgagccactgtgcccagccagaagttgggatttcaagaagcaaaacttgctcatgaaacacaatttcatcatttttaagcacacttagctgcacaaaattgtaaacaagaaagtctagatattctcagggccttaacaaaagcgttgaagaatggtttatactcagcatacctatgtggctgtagaaacaagggctgcaaacgcatgtataaactttagggtgctcacagccacccccagcctggttaaactccctagtgatactgcctgctgacatacatggaatcaatgcactagtcacaaagaattcttatctattgatgaaaacagccagccccagccctgggtctggctctccatctgagggctaggataggggcttcccagaaaaacactgtggccaggaaaggggctcagagaaacccaataccccagatagctgctaagacatgccagtcctaactttaaccccagtcccctttgggttaaagtcagttacttcacacccattttctcccttcctgcagggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacagggtaagtggtcctggaaaagagcagagaagtggcccaggggagggtacagaggaggggagaagttagccagtggcagagaagagggtttgttagaaggatagggagccaccatgctcccagggcagtgctacctacctagtgcacagagtgctgtggcctgaggctaatgtgtgcatactgtgatctcaccttagcccctttgtgtctacctcaggcaaaggtgcagattggtgtttgtggaaggggttgtggcctggccatgacagccagccacctccaaatccagctttttttttttttttttttgagacagaatctcactctgtcaccaggctggagtgcagtgacatgatcttggctcactgcaacctccgcctcctgagttcaagcaattatcctgcctcagcctcccaagtagctgggactacaggcacgtgccaccatgcccagctaatttttgtatttttagtagagatggggtttcaccatgttagccaggctcaaatccagctcactgatgtctcccttctctcttccccattcgtctctccagtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaaggtgagtctggtccctagggcaccctctaggggaaagggggagcctgggacaggaagggatagtcaggagaggcctctcagtcaagctcataccctgcttccatgtgtgtccaccacccacctcagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggaggtactgacctgtgttcaccgagaggcaggtccatgtggagaacctggaagcgccttttgtgcttgattcttcccctagctcagtatttctcgaaataggaccttgtttccaagctctgtgacactgggcaagtcttttccctttctgcttccctaccataagcctcagtttccttatttgtaatacggaaagtctcttacttacatccatagagacttctcaacagctggaggaggggcgcaagagctagagccctgcaggggcccgaggctgtgcagatgaaggctcttggcagcagagacccctttctgtgcccgggcagcctaacatttcttcagaaggcaccatcgcacttgagttagatctcagccggaatacttgctctgctaggaccaagctcaagtgtaggggccaaagccagggactgccggcatggcaggtagtcaacacatatatctaaggaataggaaactaggccaacaggcaatgagttttatacgttcttatacttttgtgcttttctcacaccccaggtactcagcaagcccttgctgatagtgtactgagtgggtgaataaatgattaattaacatttatataccatttaatctgtagtctgatgtgttttatttatattaaattatctaattgtctccattaccaatggacttcagtcctattattattttgttttggttttgtttttgtttctcaccagcctctacattaaatagattctattattatctgtatttatggatgaggcgtcctaaatacagagctgttaaagaacttacacaagctagtgaatggcagagcttaggatttgaacccaggaagtctgacttaccatcccacatgcttaaccactacactctgctgagtgaatagagagagcgggtgaatgagttgttgagtgagggagtgcacgtcatcagaatggaggggtaggctttatggtagactggggactcagggatgaagctgaaggacttacagatctagagatgggggtcaaggttatcctagggtggtattaggcttagagtggcatgggaactgttttaagaattctgggggcttgggtgagggttacgatagaggatgatggatcaggggttactgtttctcctttccagttgactgtgcagcaaaaggtgtttcacattgccaatgagctcctgcaaactgagaaggcctacgtttccaggctccatctcctggatcaggtgagtggccccttgggggtacgagggccccaggaccttgtaggtgcgtttcaaggaggcagtgatagggcctgagttcaatcccaccattgtggccagaatttagaggcagtaaggctcctctctgaccttgaagtcagcttgtccctgaagccatctctgattatgccccaagcttgatcagtgagggctgataccaaccctcactcctaacgctgggcaggtacaccagccctgactgcgactctgacactagtactgacttggacccagatcctgaatttatccctagctgtgaacttcattctaaccctggccctattccagatcccaaatccactagaatccctgagagtagagatttttatctttgttcactgctctatcttaccctctatgacagtgcctcgcacacagcagacattcaaaaatattcattaaatgaacagatctaattccaactttctctctgaccctgaatctaattctaagcctgaccttgatcctgacttctaattgttccaaagcctaactcttggcagcagggacccctttctgtgcccaagcagcctaacatttcttcagaaggcaccctcgcacttgagttagatctcagccagaatacttgctctgccgggaccaagctcaagtgtgggggccaaagccagggactgctggaataacctgaaatccatctccccaatatataaccctaaccccattccctgtctcctcagtctcaagaccaatgctgatcccaaagctccacaagcctccccacaaatactgccctcacccttcaccagccaagccccaggcccagctgggctgagtgcttctgccctgccccacaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatggtgaggggccctagacctagactgcccactcccctgtccacctgcctgccgagcccagacccagaggtgtacacaagacttcatttctgcttgctcttcctcttagtgacttttgaaaaaggaatcagagccgggcacggtggctcacacctgtaatcccagcactttgggaagctgaggcaggtgaatcacctgaggtcaggagttcgagaacagcctggccaacatggcgaaaccctgcctctactaaaaacattaaaaattatcctggcgtgatggcacgcgcctgtagtcccagctactcgggaggctgaggcacaagaatcgcttgaacccaggaggcggaggtgtggtgacccgaaattgcaccattgcactccagcccaggtgatagagctagactctgtcttaaaaaaaaaaaaaaagaaaaagaaaaaagaatcaggcccaagctctgccttcgaggacctcccagtctgatgtggaacacagaccagaactcagaaaattgcaacagaatagcatagcctacaggagtatgaggttaggagccaaattggctgagttcaaattccagctgtgccacttgctagctttgagcaagtttcttaagttgctatgcctcagtttcctcatctataaaatggggggaaataataacggcctaccttgtagggttgttttaaggattaaataacttaatacataaaagagcttagaacagtaccaggtataggccaggcatggtggctcacacctgtaatcccagcactctgggaggccgaggcaggcggatcaccaggtcaggagagcgagaccatcctggctaacacggtaaaatcccgtctctactaaaaatacaaaaaattagccgggcatggtggcgggcgcctgtagtcccagctactcgggaggctgaagcaggagaatggtgtgaacctgggaggtggagcttgcagtgagccgagatcgtaccactgcactccagcctgggcaacagagcaagactctctcaaaaaaaaaaaaaacaaacaaacaaaacagtaccagatatatacagtaagtgctcaatggatgtaagcttttgttatttttacagtgctatgatagagcagagaatgggaggctgtgggaatccagacaaatggaccaagcctagcttggagattacagaaggattcagggagaaggtgatgcctaagctgagtcctgaggtagaagggcaaggtttacaggcagcctctcaggccttcttccaatccagcctttagagtccacaccatttgccagaacggtctctctaaacaagtcagaccatgtctctccctgcttaaaatcatgtccacattccccatacctacagattctccacacctacagagtcaagtgtgtccccctcaccagactgtgaccacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacttgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctaggccagacctctgaggcaggaccccaagacttaattcacagggtcggccttccattgccacatgattgaaatcccagaggagaatctccaaactgaaaggcccacattgaggttctgaagtgagaccccaggatgagatcctccttctgaatgttctctttgggtattcaggcagggacctctaagttgagacccctgcctgaatacctgtagagaacattcagaaggagatccccaacctgaacttcccaactggaaccccagagtttgagtggcatgcccattatgatcccctaaaggaactcatccatttcctagatcgagaccccaaggctgacccctagactcacccccaaatgaagttgtaccaaatgagaaaggaaactgagcctgaaacctcagggactgagccaccaagctgagaggccagactgacccctcaggccaagcccacatcacagaatctccacagctgagctccccagaaagagccctggctcatcaattttccatcctccagatttagagctttcctccatgtccgccagccactacccagaatgaacctcccaaaagaacctccaaattgagcaccctagactggaccccaaattttccacctctcaaatttggatctctaggctgagatacctcctccccagactgaatccttacacattgaaccactagaaaagtcttctatcccgattcctccagtatcaacctgaaccccacaccccagatagagctccccccgcctaccccactttctcttccccagattttcattcattcattcattcattagtttaacagctacttactgagcacctccatgtttttgtgcattgttctaggtactggggatatagaggtgaacaaaacagacaaggtccttgatctcagggagcatatattctagtcagcaatgagacacagtaaacaaaaataataaacacacagtagaggccgggcgcagtggctcacgcctgtaatcccagcactttgggaggccaggccgggggatcgcctgaggtcaggagtttgagactagcctggccaacatggtgaaaccccgtctctactaaaaatacaaacattagctgggcgtggtggcgggcacctgtaatcccagctacttgggaggctgaggcaggagaattgcttgaacccaggaggtggaggtttgcagtgagccaagattgcatcactacacttcagcctgggcaacagagcgagactccttctcaaaaaaaaaaaaaaaaaaaaaaagagctgggcgtggtggtgggtgcctgtaattccagctactcgggatgccagggcaggagaatcactcgaactcgggaggcagaggttgcattgagctgtgattgagccactgcactccagcctgggtgacagagcgagactccatctcaagaataaataaataagtaaataaatacacagtagaatattagataggtgctgagtataattcagagaattagaagagggtggcatgacagtggctggagagcctacttgagattgggtggcctgtctgactagaagacagtgagtcaaaacctgaataaaaagaaggtaggcacatgcctgttggggttgagcatgttccaggcagaggccacagcaagtatagggtccaaggcaaggggagatattaggggaggtggggtgctggacaggttgcatatctctggatcaggaagaaggtcagtgtgacctgaacatgacaaataagagtagaatggtagaaatgaggttggagagaggagcaaagactgaaggccaagataaggagatggattttattctgagtatggtgggtagccatgggaaggtttcgatcatgattacttggggagcaagagagagagagctgagagatcagttagaagccttttgcaataatccaagtgagaaaagttggcttggatgaggacagtagcagtagaatcggtgagaaatggttggattcaggatacattcttttcagaagcagcactgagaggactagggtggagtggatgctgggcttgggagcaagagtcaggaatgacttaaaggtttttggctggtggtgatggttcctgagatgatcttaggagtctgactttggacatgttcaaagtgagctgctagtcaggcagttagatgaatctagaatttcagggagagatttggatgtcattggcacatagatagtattccaaagccataaggctggccaagatcaccaaagggagtgagtgtaaaaggaggggaaagggggccaaggacaaagctcagggatgtggaatcaccaaaggagacttagaaggagcagccctaggctgggcgcggtgactcacacctgtaatcccagcacttttggaggctgaggcaggtggatcacaaagtcaggagttcgagaccagcctggccaacatggtgaaaccctgtctgtactgaaaatacaaaaattagccaggtatgatggtgcacgcctgtaattccagctagtcaggaggctgaggcagtagaaccacttgaacccgggaggcagaagttgcagtgagccgaggtggcgccactgcactccagcctgggtgacagagcaagaccccatctcaaaaaaaaaaaaaaaaagaaggagcagccctaaaggtaggaagaaaaccaagaaagtgtggggtcctaaaagccataagaatggggttcgaggccgggcgtggtggctcacgcctataatcctagcaatttgggaggctgaggcgggcagatcacctgaggtctggagtttgagaccagcctggccaagatgatgaaaccccatctctactaaaaatacaaaaattagccaggcgtggtggccgtgcctgtaatcccagctaccctggaggctgaggcaggagaatcgctggaacccgggaggcagaggctgcagtgagccaagatcgtgccactgcactccaacctgagccacggagtgagactccatctcaaaaaaaaaaaaaaaaaaaaagaatgggaagtggacagctgtgtccactgctgtgtccgcttcccaaactgagccttctccaccctgccagatggggcactttgctaccaagcctggacccctagaaagaactaggcctctagaaagtttaatagctaagctctacaagcagacatctgcagcataagtaagtacctcattcctcctgctgaaaaagagccctcactgaggtgccagcctaaacttctagaaagggccttccagactgattgtctgggatgggccctatggactgacatctccaaactgaaccttcatactaagcccattctgaggtcccagttatagatcccaacactggtttctcaaactaagatccccagactgggcctcttcccacctggaatactcttcccacactgagccctgagagtgggttcccagtgagagccttcagcttgaggtccccaaaagagcttcccagtctgatctccttggccaccattctatagacaagtattgccaaactgagcaccctagattaattctcctatttcatatccctcagactgaaactttcagcctgaacttaaaagactgactctccaggtccatcctacagactgaagccccactgagccccaagactggattctctgagttccccagagggaaccctgaaattcagcagcccagactgagctccagacagagattccagattgtgttctccccagcccaagtcccctagactgatgacccctatttttcttttttctttttcttttttttttttttttttttttttttgagacagagtcttgctccgtcacccaggctggagtgcagtggcgcgatctcggctcacggcaacctccgcctccctggttctagcgattctgcagcctcagcctcccaagtagctgggattacaggcacccaccaccgcgcccggctaatttttgtgtttttagtagagatggggtttcaccatcttggccaagctggtctcgaactcctgacctcgtgatccacctgccttggcttccaaaagtgctgggattacaggcatgagccaccgtgcccggccaacgacccctatttttcatttaccagatggagagtcccatgatgagctccaggactaatgccctagattattagactgtcccccaaattaagccacacaggctaagtgcctagtcccatgtccacattgagcttccaggactcagttctgcaattttattttcacactggatccccaacgtaacatccccaggtgaaaattctccaaataagctccctgcactagacccaaagtgagccgccagtgaaagcaacctagagtgggctccagatagagtccattttctcaactgtatatccttgggcaagctgctcagcctctcagcctaagttttctcacatgtagaatggggatgataatgatacctacctcatatggttgttttgagaagtaatgagataatctgggtaaagctcctagcacaatgcctggcacatggtaaaggctcaataaatgttagctgcttttattactaaatgcactggctaatgcccatccctctaaaattggccccaggttgagtttaagaaatttatttattttttatttatttttatttttatttatttattatttttttgagacgtagtctcactctgtcgcccaggctggactgcagtggcgcgatctccgctcactgcaatctctgcctcccaagttcaagcgattctcctgcttcagactcctaagtagctgggattacaggcacccaccaccacgcctagctaaattttgtattttgggtagagacagtgtttcaccgtgttggccaggatggtctcaatctcttgacctcgtgatccacccgcctcgccctcccaaagtgctgggattacaggcgtgcgccaccgcacccagcctatttttatttttattttttttgagactgagtctcgctctttcgccaggctggagtgcagtggcacaatcttggctcactgctgtctctgcctcctgggttcaagtgattcccctgcctcagtctcccaagtagctgggactacaggcacacaccaccatgcctggctaagttttgtattttagtagagatggggtttcaccatgttggccagcatggtctcgatctcctgacctcatgatctgcccaccttggcctctcaaagtgctgggattacaggcatgagccaccgcacccggccttttatttttttttattatttttatttatttatttatttatttttgtattttttttttagtagagacggggtttcaccatgttagccaggatggtctcaatctcctgactttttgatccacccgcctcggcctcccaaagtgctgggattacaggcgtgagccaccgtgcctggcctatttttttttttaagtgaaagtaagtttattaagaaagtaaagaaataaagaatggctactccataggcagagcagcctgagttgaagaaattgagcttcctgttttgtatcaatcccaaccctatctgaggccccaggatgaacctcacagcttgagcttggccaactgagcttccttaatggagcctcccagattgagctccccacatcaagtccaaagatgaaactttgtccccagaaacaacttaccggtctggttttctgagctgttcagaatgagaatctctgaatgagagcccgcctgagatatgcgcactaagatcctcagcccaagatcgtaagctgagctcccaattttttacacctcagactaaattccccaggctgagcctcactgaatcatatgtctggttccccagactgacttgcccactttctactttccagactgcactctggagcctggaccctagaccaatctccccataccaggccatctggaactcctggcctcagttgcctacactgggcccaagactaaactccaaaccaagatcctagactgccaagcccagaccaggccccactaacgcttccaaaccaagcccctacatcaggccccgcagattgcactccctagcctgaacccctaagtgaaattctagactgaaatccccacactgagcccccaggtagggactgtacaccctggatccttggaaatgccagtctgtactccacatgagacatctccagacagagctcgttgtaacaaagcctccagtcagagcccatcagcctacacaggcctgagcttgtgtgcccacaacttgccagagtcttcttcctatccccttccctgggtgccccctacctctaccactcagcctgccccctgccttggggtgggggagatgtaggatgtgtaggagaaaaggcagctgggagatcattcccagctctgatgccaactctgccacccaggtaggcaacctagggtggtcaccttctccctgggtcttggtttcctcattggataaatggggcacaatcatctatgttacagggttgttgtgagggttgaaggagctaatttatccaaagcatctgcctggagagggcagtgggaccttggccctgtcctagggagctcgtagtctactgaggaatatggatgcagatgtataaatacatgatgagcactgtgactagtgggacagaagggagcaaaggagaatgtgagaacccagacagggtcctaacccagcccgagaactctgggcaggctcactggaggaagtgagctggatccagaagacagtgacagttggccagatgaagtaagacgggacatgtttagggaggtgtaggaagctggagtggtcagcagaagccacatcaccaagggctttgagtctttttttttttttttttttttttttgagacgtagtctcgctctgtcacccaggctggagtgcagtggtgcgatctcggctcactgcaacctccacctccagggttcaagtgattctcctgcttcagcctcccgagtagctgggattacaggcacgtgccaccacgcctggcgaatttttataaatttagtagagacggggttttgccatgttggccaggctggtcttgaagtcaggtgatctgcccccctcggcctcctaaagtattgggattacaggcatgaaccaccacgcccagcctcaccaagggctttgaatgtcaggctaaagggctaggtctttaccctgcaggcacaggggagccattgacagatttgagcagaggagtgacagtaaactgtgtgagaaagctccttctggcagctaggatggaataagggttggagattggagcccggcccctgaaaggcatgtggatgcctgagctgggacaggggccatagatctccgtgagcaccaaaacttggtcatgaagagagagcctcttaggaaaacacgacttggttggccagccatatggacctccttcagaagcacctctgctcctctagcacaggctgatctgagtggggagatccagcacatacagaatggggtacacaaagactgtggccaggccttaagcatgggtgggatttattagtgtgtggagatgtacagggactcatttcagctttttctttttttttttttgatgatacctggtcactataggaaatatggaaattacagaaaaagatgaaagaagtaggaaaaaaatcccctgttatctgagcccccagagaataagcacaatgaacattgtgacataaattcttcctggtgttttttagacatgtatacttgtaaaagtaagatcattctatataaacatgtttgtatccttttcttaaaacaccctgagcatttcccagattattaaaagacctacatgaggatcatttgtaaaggttgtttaatgttccattatatgaagacaccataatgtatttaactgaacccctacagttggccattttttttggcagggaagaggtacaggtgaaggtgtgctcccctacagatggacatttttgtttcccacttggaactgttgtaaataccaatatgacaaaaatgtgtttgtgtatagaatgtgtattttcctagaatagatacccagaatcagaatcattgagacaaagaacaggatcatctcattgtttctttatatggctttttctgattataaaagtaatacatgttctttgtcaaaaatacggaaaatacagaaaaacctaaagaagacaataaaaaccacccacggccccaccaaccagagacaacatgggtatgcttccttctggttacatatgtaactattattgttattattaatggtaataataatcttggcaagcttgcatttttttattggctgccaactactccatctattgtgattctggcattgtgacattggacaacttctgattttaaatgatgttgctgtggacatctttgagggtggagctttctgagatgggagggtgtgatcaggccaggaggaggtattcagggaggaaagaagccccgaggccgggtgcggtggctcacgcctgtaatcccagcactttgggaggctgaggtgggtggttcacaaggtcaggagttcgagaccagcctggccaacatagtgaagccccgtctctactaaaaatacaaaaattagccaggcatggtggcacgtgcctgtagtcccagctacttgggaggctgaggcaggagaatcgcttgaacccgggaggcagaggttgtggtgagccgtgatcatgccgctgcactccagcctgggcaacagagtgagactccgtctcaaaaaaaaaaaacaaaaaacaaagccccggaaaggctcctctctgctagtcccccatctgacctcacccctctatgcctgtagagtctctggagctgatcgccacagcagcagagcactcgaatgctgccatccgcaaaatggtgagtggcccttctagcccctgcccttccttggccacccacctgtggtgtctccatcctggagtgggggtgtcgtgacttgtgggcatctgacaggaggctggcaccccaaccgtgccttttgttccctgtcttttgccaggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactagtaagtgccaggcatggaattgtgggtgggtcatgcccctcccaacacacacacacatagtgacctggtactcactcaaagactatacctcctttcattcctgaaagaggaaaaaaaagaaaaacagactatacctcctgctagtcattctctcctctagtaacgaattgtattttcactacctagctaggattttttttctccactttacagatgaggcaaataagccttgcagagaagtgacttgcccgaggttccccactaggaagtgtcttccatgcctaggctctttccttgtgacccctgtgcccaatttgggctgtcttttctccatctattgcctacagtccttggcagtaaagcttcagggcaaggagctgggccacatccccactaggccctctgcacatacatcccaaactttttccttcctagttcaacgaccgcctcctttactgcgtgcccaggctgcggctccttggccagaagtttagcgtgcgggcacgcattgatgtagatggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttgttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaatgcagtacttggtccatgacagaagcctggtttgggaaaaagagccctaaaagacatttgtgggacaataagagaaaatgtggatgtaaagtgaacattagatattgagaaattattgctgtcttaggtgtgataatgttatggtggttatgcaggagaatggccttgttttgcagcagtgcatgctgagggcttagtgtcacaatgtctgttaattactttaaaatggttcagcacccaaaaaatacatatgtaaccatacatacacatttgcacacatatacatacatacacatatacagtcatgcactgtataaaacattttggtcaatgacagaccatatatacacagtggccccataagattaaagtatcatattttactctaccttttctttttttttttttttttttaagacagagtctcactctgtcacccaggagtgcggtggcatgatctcggctcactgcaacctccacctcccaggttcaagcaattctcctgcctcagcctcctgaataagtgggattataggtgcatgccaccacgcccatctaatttttgtatttttagtagagacagggtttcactatgttggccaggctggtttcgaactcctgatctcaagtgatctgcccgccttggcctcccaaagtgctgggattacaggcgtgagtcactacgcctgtctttactataccttttctaggtttagatatgtttacatacccaaataattagtgtgctacaaattaatacaatattcagtacaactgtaacatgctttacaggtttgtagcctaagagccataggctgtaccttatagcctaggtgtgtcgtaggctagaccatctagtgtactagtgtcagtacgctctctgatagtcgcacaacaatgaaatggtctaacgacacctttctcagaacacatccccgtggttaagtgacgcgtgactgtatgtacatatatatgaagtaaatatggcaaaatataaaaaaattttgcatctctatagtaggtatatagatatgtattgtacttgtgctatcctgtttacttttttgtatgcttgaagttttttataataaacattttaaaataatagcatgggatgatggccagccatttaacagaggggcctttcatatccattctctacttcgatgattataatcatagctcatatttcctcaagacttagttttttgccaggtgctgttttaagttaatgttaacttaaaattttaagtctaagttgactagtcaaaagcttacaagagccctagaagtagctactgttaccataaatctactttacaaatggggaaacttaggtgtaggacagttctgcatgcagggcgcagtggctcacgcctgtaatcccagcactttgggaggccaaggtaggaggatcacttgaggccaggagttcgagaccagcctgggcaacataacgagacctcgcctcttaaaaaagaaagaagaaagaaagaaaaagaatatttatgtacttgcccaagatcccagagcaagaaaggagcagagctgagattggagctcaggtcatccggccctggagtccacattcctaaccactgtctatgctgccttctgagggaccaggtgaaagggtatcagggtcatggtgagggccagaggatggatgcatgtcagcagatggcctgcttctgacaggctgtgagaaagtgagaaatgactggctgggactgcaaggaggtgggagagagagatgaatgtgagatagagggtatcctcctgggggatgaagtgagtcttgaagcttggggagattgagagcctcatggaggcctgcagcagggaaagtgagagcaaagcagatgccctgcacatccaggggagtgacaagccacgtgacagggactcatcatctgcagagaggaaaggggctgcagtgggacactgggcccagaaggggcagccaagcaatgtaggatttcctcctagtggcagcaggaaggcatggagggtttgctttgctttgcagtcacttttactgcccttaaaagaaaaaagaaatttaatgcaaattttcaaatatccggaaaagtgtaagtacaacaagcacccagatgcccacaacttagacagctgcttctcaactttggcaacctttggaatcagctggggagcttttaaaaaatacggatgcctgggacccacctgcagagattctgatttaattggcttgggggatagcctgaacatggagagctctaaaagccccccaggtgattttattttactttttaatttttatttatttatttttgagatggagtctcactctgtcgcccaggccagagtgcagtggcgccatctcggctcactgcaacctccacctcccgggttcaagtgattctcctgccttagcctcctgagtagctgggactacatgtgcatgccaccgcgcccggctaatttttgcatttttagtagagacggggtttcgccatattggccaggctggtcttgaactcctgaccttgtgatctgcccggctcggcctcccaaagtgctgggattacaggcatgagccaccacgcctggtccctaggtgattttaatgtgtgtatcagggtgtacaaccacttatttaagagtcaacaactactgacattaaatgtcttttgctgaaccattttaaagtaaattacaaatatcaggacacttcacccctatacacttcagcatgaatagccaaaaaactctactatactgtagttcttttttttttttttttttttttttgagatagggtctctccctgtcatccaggctagagtgcagtggcgttatcatggctcccttcagcctcgaactcctgggttcaagtgatcctcctgcctcagcctcccaagtagctgggaatacaagcatatgccaccatgcccagctaattttcgtattttttgtagagatgaggtctcactatgttgcccaggctggtcttaaactcctggcctcaagcaatcctcccgcttcagcctcccaaagtgctgagatgacaggtatgagccaccactccgtctattgtggctcttaaaaataaaaagcaacacttgttcacttctaagaaattataaattagaaaatatagataaataaaatatttcttttttttgagtcgcagtttctctcttgttgcccaggctggagtggcagcaatggctccatctcggctcactgcaagctccgcctcccaggttcaagcgattctcctgcctcagcctcacaagtagctgggattataggctcccgccaccacgcccggccaatttttgtattttcagtagagacggggtttcaccatgttggctaggctgacctcaggtgatccagccgcctcggcctcccaaagtgctgggattacaggcatgagccgctgcacctggccaataaaataattttttaaaagaatacaatcagaataggccaggcacggtagctcacgcctgtaatcccagcactttgggaggccaaggcgggtggatcacctgaggtcacgagttcaagaccagcctggccaacatggcaaaaccccgtctctactgaaaatacaaaaattagccaggcatggtggcacacacctgtaatcccagctactggggaggctgaggtaggagaatggcttgaatctggaaggcggaggttgcagtaagctgagatcacgccactgcactccagcctgggtgacagggcaagactccgtctcaaaaaaaaaaagaatacagtcagaataaagtgattgcagtgcagtgcagggcagacagaagagtcagggaaggggaacgcacactgattgagcatcgagtgtgccagacattgtgctgagcactgtacacgttacctcggttactgctgagaacccagagagtgataatcattatctccattttacaaatgaaaaaaaaactaccctcttttctcaacttgacacccagcaacagagaattttttttcctttttgagacagagtctcactctgtcacccaggctggagtgcagtgggacgatctccgctcactgcaacctccgcctcctgggctcaagcgattctcatgcctcagccccctgagtagctgggactacaggcatgagccatcacgcccggctaatttttgtacttttagtagagacagaatttcaccatgttggccgggctggtctccaattcctgacctcaagtgatccacccgccttgacctctcaaagtgctgggattacaggtgtgagccacccacacccggccaactgataattattgacacggtttcttttatgttctatattctctcccacacatttcacccttacccctctacctgaggcctagcacctccttgaaaagtcctcacccaaacttcagactggggcatgtcacctcctctgggctccttggccttattttcaccatcaaaacactgatctccctgtattgtccctgtctatttcctctactagaccatgagctccttgagggcagggtcctctctgaagctcaagttcttagcacagggtctggaaagtattagtaatcgttgaataaataaacccaggcagattatgtgacttgcccaaggtcatataagtaataggtgaagaagagggtcaagcccaggtctttctgactccaaaacacctgctcttccactcctattgctttttgtgggcctacctaaccaaacatctttcttttttattccccaccccaaggactgaggaggagaagaaagactgggtccaggtaacatccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagcccatccccaccccatgataatccaagcgttggagcaggaacaagggctggctggactgggctggggagtagctgtctctgacctgagacctggccctccctacagaacgtggatcttgggaagcgggcacctacgcccatccgggaaaaggaagtcaccatgtgcatgcgctgccaggagcccttcaattctatcaccaaacgcaggcaccactgcaaggcctgcgggcatgtgagtgttgggaggcaggggcagagctagggaggggacagaatggcagcccaaaggcccactgcagagtgggtaccctccaagtggggggaggccacaagtctgctgtgggagttggtatgctgaagggaagacccgctggaatcaggctactcttgcccacttgccaccccaggtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggaggtaagagccagcccctgactaactctcccacagtgggcaaatgggttccaactctacccagtgagactgaggaggcccgagtatttgggaaacagtagtgatcaagggacccaggcttggagtgaataaaatgacggcaagagtgaatgaaagacagtcatctttaagtacttagacatttaatccccacagtaactaatctgcccatgctattgttctctttattttacaaacgaggaaactgaggcccagaggggtcatttgcccaaattacacagcaaatgagtggcagcactggatttttttaaaattaaaaaattggctgggcacagtggctcatgcctgtaatcccagcactttgggaggctgaggcgggtgaatcaccggaggtcgggagttcaggaccagcctgaccaatgtggagaaaccccatctctactaaaaacacaaaattagccaggcatggtggcgcacgcctgcaatcccagctacttgggagggctgaggcaggcaaatcgcttgaacctgggaagcagaggttgcggtgagccaagatcgcgccattgtactccagcctgggcaacaacagcaaaactccgtctcaaaaaaaaaaaaaaaatttaaaaattgtcttttgttattacaaagtaggataagtagaccaatataaacaaaaaataataaaataccgtatcccttctacccaaaagttaccattgtgagggcttatcctatctttctaggcatatatgcacaaacacacattttggagatttttttaaaaacaaatctaggtatttatttaacacttaaaagagtacttactctgtgccaggaactattctaagcactttgcatatattaattcatttaattctcacatcagctctctttgctctccaagtcaatacattttcatctagagctgggattctaagccagacttcattaaccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgaggcaggagaattgcttgaacctgggaggtagaggttgcagtgagccaagttcatgccactgcactccagcctgggcaacagggcaagactctgtctcaaaaaaaaaaaaaaaaaaaagtatgcagataggggcaatagcatagacaaaggcctgaaaacattatttggtatgctaaagagactagcccagcagttttgtgagaagaggcgggggtggggggagacaggtatttaaaccagcctgcattttagccccagttctgacatgttcctgttgataacactggagccacggaaggttcctgagtaggggagttcctgagtaggggactgaagacagagcatatgcaaaaccagttagaagctggggcgggggaaaggtctagccccaaggtggccccagctctgtccctcctcccgccaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagta

SEQ ID NO: 3423 - DNA, 47079 bp, human
ctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaaaaaaaaaaaaaaaaagaaagacggtggattgatccaaggttgagattttgccaggtgtgtgtggcgggagaacaagggaaggaaggagtagaaggtgctgagagagaaaggtggaagaggtgggccttgggagtcaggctagaggagaaggctggaggggctgataggtagggagacagcagaaaagccaacagaggcagaagccagttgtagcaggagctggagagctgcaggtccacgaggttggttgtgatgtgaaatcaggatggtttcttggatttgaaaaggtggagcagctttaagtcaggctgaggccacagaccactgcctttgtgctacacagacctgagtgtctgaggagcacagcaggaccttccccatctggggacattctcatacgggcctgagcccaggagccacagaagaagagcagcgcacatctgccctgccttccactgggactgaaggagttgttaagcccttgggggctcccgggttcacacctcaggctccacagatctctgggaccgtggccttgcaccaggtagcagtagtgaagtataaagcatgggtaggatgtgccttttggtgccttcatgaccttgggctagtcatggaacctctgggagatttcagggggctccctcagtgtgggctgaagataaccagctggcaacaggcccttaacaccttggcctgcatgttacttctgctggctttccaaactccccttgacactgtgtaaagccagtgcctttttgcagctgccaaaacaggccacaagcactcccaccccaggacttttgcattggcttttccttctggctggaagctcttcccctagccctccacctggcttgctcctcgtcttgcatgtctcaggtcaaatgtcacctcttccaagagactgtccctaaccactttaggtagggccacttgtgagtctccatcagagactgtgagtgtgcttccatctttgcacttagtacaatctgaaattatcttattgtatgtgtctactcgtttattgcctatcttcctctactagaatgtgagctccatgggggcaaggcgattatatctcttttgctcactgttgtatccccagcaactagcgcagtgcctaacacgcagtaggtgttcaagaaatcctcattaaataaatgcctaaacagatactaaagaagcacatagtaggccctcagtaactattgcctaaaagaaggacaccaaattcctgccctctggatactcttgatctgaaagtcagtagctgggcaatgtctagacccccagtctctggcctctgtaatcaatacaaggtgatgattctgagtatgccttcccaatccaccaattcattcaaattacaaatcataatacccttcctaaaccactctcctcctccccaaaaaggcaacacagagttcccaggatccttttccccaacgaagtccttgcctctgtaattgcatagtgggtgtcttttttttttttttttttgattcaagatggggattaggaataagacaagtgtcagggaaggacctggcctcctattctaactaattcactttgtgaccctgggtgagtgacttttcttctctgaacctcagtttcttcatctagagaatgcaatgaggagtctatgaattaatggttgtaaagcctgcagcatggtataaatcctcagcaaccaggagtttaaaaaaataaaattaagttaaaaaataagagaaaaaccttctgaagaagaggcggaggaattactcaggccctgactaggcgggcgccgggccatgtgattcactgcagcatgggttgtgagaggccacctcccccactgcccagccggcccaggggtaggcacaagtgacttggcttctctctccatgggactcgcctataattggccctaagagggcagggttagtggttgtagggtgtgtgtgtaagagagagacagagagggtttcctgagcttcaattaaagggctgaaacatgctggtccacatgttaagatttctgtgtgcctgctgacttcctccctaacactgctgagacctttattgaatcaccatctttagggctcagtggctcatcctgggggtggggggaggcttttaaaaataataattgtatcttagccatgtgaacagccttgaattgcttcaaagtgctttctcttttagtgatcctgtctgcttcctggtggggaaaggtacagttgttattatgcccattttccaggttgattaaaccgaagtccttgttggatcactgggaaaacccagtgaaatgccagagaggggtttgagagagtcagaaagcggtttgcttgcaggggtttgcagagatggttgctctattcctcagggttgaggcctagaatgtcctttcagatgcagggattgtggggatattggtgtctgaccctagctaagtcaaaggagttgcacctgatgttagagccgttttgtgggtaatgggggaaactgagccagttgaggggggcaaggggaggggctgactctttctcatttggatcctgaggcatcttcagagtctccaagagtaagaattggagctagaaaagactctagatactgcctcgttctgagtttccctaactgagtgagcatcagaatctcttgttgaccttaaaaaaaaatgtgattccacactccacctcagagtgccagaatcttggggttgacaaccaaggaacctattttcaaaagctccttaggtgattgtgatgcacagcctagagtgggaaccactagttaagtccgttttccagatgggacagtgaggaaggctcagagaggtagtgatttttttagccatcatcctacagtgagtcagcatcattagggccaggagaatacatcggcctccccatctaaggccctttccccagggccccatgtgggcttctgtcaactcactcccaaccgcaaatggaggcatgggattaaacacaaagggagagtcaacctcctgccctcatacacacaaacactggctgcctcagtttacccttattctcagctctcgtgaatggctaccatttggcagttcaaattggaaggcagttgccattctgggactctaggcagaggaaaccctggcatcatcagtgcccagtgcaggatctggccctaaggaagggttctagaggggtgtcaataaagggttgtagagctagagaagaacatggaggacaattcaggtaagaggttcagtggaagcaaaggcagcgagacatggggcactggggaatagggctggtattgggaggagtggagtgacaaggctgacaaggaactttcttctgagggtgaagagaaaccatcgaagggtttattaacgagaatgacatgctcagacggggtgtttggaaactctccctagctgcatggggagaatggatggaaggggtgcaagagtggaagcagggagacaggcaggtgagtgttgcagttttcccagagagaggtgatagcttgagttagagcgatgggaggtaaggagggtaagatctgagagatatttagatgctagcatggacaggccttggtagtagcttggatgtagaggctgagacagaaggcaaagtccagattgctccatgttgttttctgaaaccaactacagtgacctggtggatgttggtggggccatctatatacaagagagggaggaggtttgagggaagatagtgaattatgtttgagacaagttgaattcgaaacgcctgggggtacatgcaggtgaagatggccagcaggcatttgtgggtttggttcatttttgttttttactacccaggatgatcacttttaatattttggtctgttttctgctagatctttttctacatattgacgtatattttacataattgaaatcatactatatgttcaactttatatcatgctttttcatttaatatatgtatttttccaatatcattaaaaactcttcatgaacattttattttttttgaacaacattttaatgactgcataataatatgccattgtatggatttaccataatctttttttaaacttttattttaggttcaggggtacatgtgcaagtttgttatatgggtaaactgcatgtcagggggatttggtatacagattatttcaccacccaggtaataagcatagtacccgataggtagtttttcgatccttaccctcctccctccctccaccctcaaataggctccggtgtctgctttttgtttctttgtgtccatatgtactcaatgtttagctcccatttataagtgagaacatgcagtatttggttttctgttcctgccttagtttgctaaggataatggcctctagctccatccatgtttctgcaaaggacgtgatctcattcttttttatggctgcatagtattccatggtgtatacataacacattttctttgtccagtctactattgatgggcatttgggttaattccatgtcttcgatattgtgaatagcactgtgatgaacatacatatgcatgtgtctttatggtagaacgatttatacttctttgagtgtatacccaataatgagattactgagttgaatggtaattctgcttgagttatttgagaaatcaccaaactgctttccacaatggctgaactaatttatattcccaccagtagtgtataagcatttccttttctctgcaacctggcatgttattttttgactttttagtaatagccattccgactggtgtgaaatggtatctcattgtggttttgatttgcatttctctaatgattagtgatgttgagcattttttctttttttttttctctgtcacccaggctggagtgcagtggctctatctcagttcactgcaacctccgcctcccaggttgaagcaattctcccacctcagcctcccaagtagctgagattacaggtgcttggtggcaccacacccagctgatctttgtatttttagtagagacggggttttgccatgttggccaggctggtctcgaactcctgacctgaggtgatccaaccgcctcggcctcccaaaatgctaggattataggcgtgagccaccacgcctggctgatgttgagcatttttttcatatgcttatcggccacatgtatgtcttcttttgaaaagtgtctgttcaagtcctttgcccactttttaatggggttgtttattgcttgttgatttaagttccttacagattctggatattggacctttgtcagattcatagtttgcaaatattttctcccattctgtaggttgtttactctgttgatagtttcttttgctgtgcagaagttctttcatttaattaggtcccatttgtcaatttttgtttttgttgtaattgcttttagtgccttcattatgaaatctttgccaggtcctatgtccaaaatggtatttcctaggttgtcttccagggtttttatagttttgggttttacatttaagtctttaatccatcttgagttgattttagtatatggtgtaaggaaggggtccagtttcagtcttctgcatgtggctagccagttatctcagcaccatttattgactagggagtcctttccctattgcttcttttgtcaactctgtcagaggttagatggttgtaggtgtgcggccttatttctgggctctctattctgttccattggtctgtgtatctgtttttgtccagtaccatgctgttttggttactgtagccctgtaagtatagtttaaagtcggtagtgtgatgcctctggttttgttttttgttgttgttttgttgttgttgttgagatggagtctcgctctgtcacccaggctggagtgcagtggcgtgatcttggctcactgcaagctccgcctcccgggttcaagcaattctcctgcctcagtctcccaagtagctgggactacaggcacccgccatcacgcctggctaattttttgtatttttagtagagacggggtttcaccgtgttagccagggtggtgttgatctcctgacctcgtgatccacccgcctcggcctcccaaagtgctgggattacaggcgtgagccaccgcacctggccttttttttttttttttttttttttttttttttttgagactgagtctcgctctgtagcccaggctgaagtgcagtggcatgatctcggctcactgcaacctcctcctcccgggtcctggttcaagcaattctcctgcctcagcctctcgagtagctgggattacaggcacacgccactgtgcccagctaatttttgtatttttagtagagatggggtttcgccacgttggccaggctggtcttgaactcctgacctcgtgatctgcccgcctcggcctcccaaagtgctaggattacaggcgtgagccaccgtggtttggtttttttgtttgtttgtttgtttggttggttttttcagacggcgtgtcactctgtcgcccaggctggagtgcagtggcatgatctcggctcactgcaacctctgcctcctgggctcaagtgattctcctgtctcagcctcctgagtagctgggattacaggcgcccgccaccatgcttggctaatttttgtatttttagtagagacatggtttctccatgttggccagactggtctcgaactcctgacctcaggtgatccgcctgcctcggcctcccaaagtgctgggattataagcttgagccaccatgcccagctggctttgttctttttacttaggattgccttggctatttggacacttttggttctatattaatttttaaatagttttttaaaattctgtgaagaatgtcattggtagtttgataggaatagcattgaatctgtaaattgctttgggcagtatggccatttgaacaatattgagtcttcctatccatgagcatggaatgttttcccatttgtttgtgtcatctcgcaagcaggcatttggacgtaagattggaaagttcaggaaagaggcctgggccagtgatgtttgggagttttcaccaccaacacataccatgtatagatctgggagccagtcccatccttgaagacagacagtaaggttggcagggtcacactcagatgaattattcagtacctgctgtaactttgccatagaaatgccttttttcaggggaaagcagtttttaaagtatattttcatgaagctgagacccagccgtttttaaggcatatttgagggctgggcacggtggctcacacctgtaatctcagctgctcaggacgctgaggcacgagaatcacttgaccccgggaggcagaggttgcagtgagccaaaattgcaccactgcactccagcctgggtgacagagcaagactgtggttttgttgttgttgttgttttctttgtttttgctttttgacggagtcttgctctgtcgcccaggctggagtgcagtggcaatctcggctcactgcaacctccacctcccaggtccccgttcaagcaattctcctgcctcagtcttcccagtagctgggattacaggcgcacaccaccatgcccagctaatttttgtattttaagtagggaaagagtttcaccatgttggccaggctggtcttgaactcctgaccttgtgatccgcccgccttggcctcccaaagtgctgagattacaagcatgagccaccatgccaggccaagactgtgtcttaaaaaataaaatcgaccgggcacggtggcacacgccagtaatcccagcactttgggaggccaaggcgggtggatcacttgaggccaggagtttgaaaccagcctggctaacatggcgtaatgttgtctctactaaaaatacagaaatcagccaggcgcagtggctcatgcctgtaatcccagcactttgggaggccaaggtgggtggatcacaaggtcaagagatcgagaccatcctggccaacatggtgaaaacctgtctctactaaaaatacaaaattagctgggcgtggtggcgcatgcctgtagtcccagctactcgggaggctgaggcaggagaatcacttgaacccgggaggtggaggttgctgtgagccaagatcgtgccactgcactccagcctggtgacagagcgagactccgtctctaagaaaaaaaaaatcatccaggtatggtggcacatgcccataatcccagctactcaggaggctgaggcaggagaattgcttgaacccaggaggcagaggttgcagtgagtcgagattgtgccactgcgctccagcctgggtgacagagcgagactctgtctcaaaaaaataaaataaataaaataaagcatatttgccgggcacggtggctcacgcctgtaatcccagcactttgggaggccgaggtgggtggatcacaaggtcaagagattgagaccatcctggccaacatggtgaaaccctgtctctactaaaaatacaaaaattagccaggcgtggtggcgcacgcctgtagtcccagctactcgggagactgaggcaggagaattgcttgaacccaggaggtggaagttgcagtgagccgagatcttgccactgcactccagtctggcaacagagcgagactccatctcaaaaaaaaaaaaagcatatttgaagccagtcatggtgcctcacacctgtaatcctagcactttcggaggctgataggggaggattgcttaagggcaggagttcatgaccagcctgggctacatagtgagaccccgtctctacaaaaaatatttttaaattagcagggcatggtggtgtatgcctgtagtcacagctacttgagaggctgaggtggaaggatcacttgtgtccaggagttcgaggctgcagtgaagtatgattgtgccactgcactccagcctgggtgacaaagtgagactctgtctcaaaaaataataaataaataaacatatttgcatgaagctgagacccatttcacgtacacccagggtagctggctattgcaaagtattgagggaggagtacttctgaaaagcaaatcaaacattggtaaagtaaatttgtgtggttcccagtgttctctctgttgagggcatcctgagaggccagtgagggggtttgcttacggaaaggagaagagagggcttgggacaggaggggatcgtggggtctgctggggagttttggagagaagtagtttgagattccaggggagagtctggggaaagaaccaaatttggttcctagtccactagggccttccaaacaaacacaacaaaatgtaaagactctgggtagctgggaaaaggacttccccagacaagactaaaagaatagaagcttctaaattgcagatggctggcagtccgctcttggccctttcaggcccctctgtccctgggggagggcccaggtggggctgcctgcttcctcaagggagagtggagtggcagctaacaatgccccacacaaacccaagccatggctttctgggggccagttagctaaatgccttaggcagatgtggagctggccagacgctggctgggtggggctaggacctgtctggaatgagggcaggaaatgcagtctgccattggctagcaccacagagttcagttccctcatctggagagagcaaacatctttggagcaatgagtccagcctctctgggctctggtgcccagttccttggacctagaaggtgtgacacctccaaacggtgtctgaaaacacacacagctcctgagacaaggctgcagggcatagccgggggagcctcagcactcctagctctgctattggttcactgttcctccaggcctcccttcccctctcagggtcttagtttccctatttgtaataccacaaacctggtcattgtggcatcaataaataatacttggtgagcaaatagggtacaggggaagggagagtgaaagaggggagcaaggggggcatttctttatttaacatgtacctgttgagtgcctactatgtgctaggccctgtgcttaggtgccaggtaggcaacaagacagtcactatccctgtcctcgtggagctgatatctagcaggaaagacacactacaagcaattccaagtgcagatgctgcaagaacacatgagggtggggggagtgggcggacagggcaaaggagatatttgagttgagacctgaaggataaataggagtccagaggtagggagaggcagactagcagttcgggtcacgggaacaacatgtgccaaagccctaggcggaagagagcactttcgaggaacagacaaacggccattgtggctggatcgtggggcggggaaatgttcctgagctaggccttccttgtccctgtgctcaggagtttcacccctgaaggcaaagggagcccttcacaaggctgaagggattgcaggggactgtgttttccaaaagctggcagtggtgtagagaatgcctcgtagaggcccggaagatgggagtgaaatcagttagggggctggagggggaatgaagcatagggattctagagcaactgaccatggtgcatctaaaggacttggggcctggctggacatgtgggttgagggagaggaataaacctaggacttgggcttgggcagctgggcggatggagttgtccttcctgcgatggggaaggcaggaggagaagcagaccggggctggggtaggagtgtcgttcacgatgtgctgaggctgaggagcctgaagacaggacatctaggtgacagcacccagttggcatcagatatgcctatctgggtcccagagtaagggcaggtgggtgaggggcacaggtatgtagctgagactaagagggaagagccctccttggcgcttccccatggcccctgcagggaaagggttaaatcgcggagggaaggcgcctgtggaaagcgggaaaggcgggactggcagggctggcctttgggagctgcagctggcatagaagcccttccgcccgccagggcctgctaggcctgggccgccaccgcccacaccaccgcctttgccttcgcctttgcctttgccttccctgctccccctccagccccttccctgctcccctaggctgggggacccccctacctaatgcattccaggtgtagacgcagcccctcccccaccgcgcgggtgtgggaggggcagggaaggctggggtcactttcaccgcatctcttagggagcatctcccaggcttgctgactgcttctctctctctggagaattccctcagggatctctgtttgggcctccctgactctggcaggggctggcagcagagagagccccccagacccaggtccgccactttctaaagtgtcacgtgaccttgggcaagtcatctcacccctctgagcctcggttttctcatctggaaaatggggctgtcattcccaccttctagggttgttgtaaggattcaatgccacagatccatccccagcccttggcatggcacattgtcaccatgttcaacagatggccctggcctgccctttttgttcctgcccctctgcctgggtctgtatccctcgctgactaccatgccctgtgtggacctttctgtctctgtctcccttctgacttgtcccttccttttgtccatctccctctatgtccatctctgggtctctgtggttttcctgtcctctccctccttgtgtttgtcccagtgtctttctcttatcatctgtcttttcccctcataatccttctgtgtctccaactctcagatttggccaggcctctggtgaatgggaagggagatgggtgggtgttggggtccctggggttgaggcaagggtcagagggaccatccccctagcggctttgcctcacaggaaggggaatctcagccagcgtggcagccccagcatctggtaattactgctcccagtgctcccagctgcagttccactcccttcccttcctgtcctctgaagtccccagctcctcccggggcgggggagggagatgggcgggggtggagctaccgccccctatcctctggcctctagtccagagaagcagggaggaggtggccaggccctcacagtaatcaaggaactggaagagggatgggctgcttgtgctctcatgtggctgcttggtttgtctgtgtgtgtgtgtgtgtgtgtgtgtgtgtgtgcgcgcgtgtgcgcgcgcatgtgcctggccttctttgtccccgtggatctattttgtgtgtgtgtcttaatgttcttgtttctgtatggccatctgtatgtttgcatatagatccatgtgtgtctctgggtctgtatgtgttacgtgctcctctgtgcctggttgtatgtcaccttggccctaagtatgtgggagtttctagatgtttctgcgcatgggtctccttagatcttgtggatgtgtctgtctgtttctatacctgtgtctgttcccgtgcctgcgtctgcctctgcatgccccctataggtctatggttgtggtgtagggaagggggtgtctgcttgcttgtatcttttggcctttcctgatccttcttcctgctgtggagccttcttgcaaacccatgacattacgtacttcaaatatatgcttcactcatacctccccacccaatatccacacttttgcccactcttcttcccttgtctgcagaaccattctcagtccatctatacctaaaaaaaacacaccccatcctggatggtgcaactaaaaaccacctcctttaggaagtcttctctcctcccccctccaaatgtgatttctttcccaactcagcagtcactgaaggtgtgctctgtgactctggacacagacacacctgggatctggtcccagctcaaccacttttagctgtcctcaggcaaattattttgcctctttgtgcatcagtttcctcatctgtaaaatgggtaatagctcaccggatcattaggaggatgccatacgagatagcatcaacacaacacctggcccagagtgggtgttcagcagttgaatcctcatatcttatatcctctactaaaaagtgaacagcttgagttccagagatttctgcatattcttacaatctcctgctctctcttctttaggcatcctgcacagggcagaaggtaaatcgggtcacacagaacaaaaggcagattccaattcagggaacttctgacaagtaatgcatgggccagctccctgagcctgctcagacacagaggaaactgggcccttccagggagtgggagataggacctgcaaggcttctactcaagggcaagagcatgtgagatagggcaaggcataaacagcaggagtagaatgagccttcaggatcatctaactcagatagtgcaacatgatggcccacaagttgaatttgactcacaagtttcatttggcttgcccacagtttttaaaattaagggacttcacatgaaaaacctggatttcccggccgggcacagtggctcatgcctgtaatcccagcattttgggaggccgaggcgggtgaatcacctgaggtcaggagttcaagaccagcctggccaacgtggtgaaacctcgtttctactaaaaatccaaaaattaggcagatgtagtggcgtgtgcctgtaatcccagctactcgggaggctgaggctggagaatcgcttgaactcgggagacagaggtagcactgagctgagattgcgccactgcactccagcctgggcgacagagtaacactctgtctaaaaaaaaaaaaagaagaaaaatctggatttctggattcccttgaaatattggaagacctgacaatacagcgccacattactgcaagatgacacctgggtggaggggagaagctgctgcttctacttcaggttaggcatgtgctttccagtttaacccagtccccaccattccccatggccttagactgtcccactctacagaaagttcctcactttatactagggtctgcactttacagaaacatccttctctttacagaaggggcctcactttacaaaaaggagttctcctttttaacagtcttctgttttgtcatgatccttaagagtcctttggttacaaacaggccatccattttacaaaagggcctttagagaactctcctcactttacagcatgtccctccactttgaagaaggctcctctttttggaaaaacttcttccctttacagaagggccttctgtttatcaaagagatctccatttcacagaaagtgtctccgttttgaaggatggaacactcttcaggaaactcgaaagagttaggaagctcctgacttgccagaatggcccccacttcttgaaagtgtcttcacactatagaaagtgcctccatttttctgcagagtccttatgttgagaagaatagtcgacttcagggaaggaacccctgagctacccacagggttcctgtaaacagctccttctgcacatttcacacttgaccgagctttgtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccggaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggggccctagtagctgtcttgagattaagccaaggctacagctgggagaagtgagaggggctgctactagctgggagggggaaaacttggcagctgagattcccaggaagggttgagggagatgcagggtccagttccagtgggaatgggcaaaaggagcccttgtcctcagacacagctagatgctggactttctctgccagtaaacccagaagcatgtgctcagggcacctgccacgcaggggcatgcagcaaccagaaacaatttttgcaaggattttcctatttcaataataataaattgtcatgggaaaattcaaacctcagctacacttcttgacacttattttacagtttttttctggtttgtattttgaattgaatttgaatggggaggacagggcaccattgtcttcactgccctaccacctcgcataggaatcctgccctgatctgcagagctatcctggtgagtggggctaggttctgtgtctctcactggctgagtttgcttgtgtttctcagtgtatatacagttttacgttgggttgcagcctacagcccgtgggcttatgtatttatgtgtgtagttttgtggctttgtggatgtgtgattctgttggttttcaaatttaacccatatcactctgtgtgtgtggtggggtgggggtgggtcactgtgctctttcccttccttgtcccataggctcccccaaaccaaggaactgctattattgtccttctttccagataaagaaactgaggctcaggtagatggggagacttgcccagggccacacagctagtaaaaggtagtgttgtgatctaaactgaggtctgtgcaagtcctaagccagctgttcctaatacaggtgctgcagcagttcaatccgtgcagttcagtcagtgatcatgatgacaccacccttgttgggaatagtcaagtatcatagttttataaattagtgacttaagaaaaaaaaaaagaccagattcaaggccatccctgaaataatggcactgtcgtgagcattcagatgcccatggcagaaaaaattgggtagagtccctagcctgcttgaggcttaagtggacaagagtctgggggaactctggctaccaggtgctgtcttgaaggcccggctctgccacattcatttggaagctttccctgactagcgttgccagaattagccttcagaaagtatttaatacaattagatttgaatttcagatatacaataagtcattttgtttttagacggggtatcactctgtcgcccaggctggggtgcagtggcatgatttcggcccactgcagcctccgcctcccgggttcaagccattctcctgcctcagcctcccgagtagctgagattacaggcgcctgccaccatgcccagctaatttttgtatttttagtagagacggtgtttcgccatgttggtcaggctggtctcgaactcctgacctcatgatctacccacctcggcctcctaaagtgctgggattacaggcatgagccactgcgcctggcccaacaagtcattttttaagtatagcttaagaaattgttagtataagtattcatgagacatattatactaaaacattccttgtttatctaaaattcaaatttaactgagtggccgggcatggtggcttacgcctgtaatcacagcaccttgggaggctgaggcaggtggatcacctgaggtcgggagatcgagaccagcctggctaacatggtgaaaccccatctctacaaaaatacaaaaattagctgggcttggtggcaggcacctgtaatctcagctattcgggaagctgaggcaggagaattgcttgaacccaggagtcggaggttgcagtgagctgagatcgcaccattgtactccagcctaggtaacaagagcgaaagtccatctcaaaaaaaaaaaaattaactgagtgtcctgtattttatctggccaccctatccattctcctccactgagcttccccagtccccacaggctcgccctcgttgcctttcctgagttagagtctttgtctttgagattgggagctccctgagggtaagggtcaagattgcccttctggcctgctgaatgcctgggggggcaggggtttgagagtggggcaggaagggtgcataccccacccccatccccacagcagagctggcacagtgcactggcactcctggggtgcctagagtatgctttcctaggtgacaagagatgtccgagtggcagtggtggttgtgtgtgtgcagttgtgccgagcacggtgcacacagacatgagtagctctgtggttctctctctgggtctttgagggatgtgcacagttggtgtgtggctgggtacatttccacaaagtgttatcagatttggtggtggctgggtgtggtggtacacacctgtagtcccagctacttgggaggctgagacaggaggattgcttgagcccaggaattcgacaccagcctgggcaaaatagtaaggcctcacctcaaaaataaaaaataagaaagatttggtggtgtgaccaaatgtgtgtgacgggggctttttggtgatctctgctctactgggcattggggaattataaatccgttgatggaaggggcagtgctggtggaggatcttgtcaggtgtggaggtgtgggtgtgggtgtgataatgttgtggattatcaaccacaagaaaaatgggctggaattgggcacactggctcatgcctgtaatctcagcacttttggaggcagaggcaggaggatctcttgaagccaggagtttgacaccagcctgggcaacaaagaaggaccccatctctacaaaaaaaattaaaaatagccagccatggtagtgagtacctgtagtcccagctacttgggaggctgagatgggaggatcacttgagcccaggaatttgaggttacagtgacctgatcacactactgtacttaaccctaagcaacagagcaataccctgtcttaaaaaaaaaaaaaagggctggagaaaatgaatccaggaccttgctgggtagggacgggatggggcagtgggaatggctgtggtttctaggaaggaggaggggggcctaccctgggagctccccaagggcagggatgggattttctcatctccaagcacagggtctactaggttcaaaaatattctggagaccaaactcagccaaggaaagccatagagttcagcatggtcatgaggggccactgagagctagctgagaagtttctttttttggtgtttttgtttgtttgtttgtttgtttgtttttgagacagagtttcgctcttgttgcccaggctggagtgcaatggtgcgatctcagcttaccacaacctccgtctcctgggttcaagcgattctcctgcctcagcctcccggtagctggtattacaggcatgcgccaccacgcccagctaattttgtatttttagtagagatcgggtttctccatgttggtcaggctggtctcgaactcccaacctcaggtgatccacccacctcagcctcccaaagtattggaataaaggcgtgagccaccgcgcccggcctagctgagaagtttctattttcccatggacagtagggagttacagaaggttcttgtgcaggtaagtggcatgatctgagctggactgtacgtaagttcattcagccacctggagggagcaagacttggagccaaggaggccactgagggaaaataggagacagggaaatgtaggcagagagacaagggagagggagttctgaaacgagagggagggatcttgaaccttctcccgctcagtgaaacctagcctggttcttggccaggcctaggctcctaaactggacccctgttcaactccctgtggacagggttgaggggtgtccctctgactagctacactgcagtttgtgactttcggaagccgttgggtccacccgcccctcctggttcccctcttttccagcttgcccttggagagcagggttaataagaaaggaatccagtccatgaccagtctgcccaaaagtgtgccattcattgatttgctctgtgaccttgggcaagtcactgcctctctctctgactccatctcctcactagaaactgggctgacaatctcttttcctctcacctgggactccagggaatctttgcatttcattcagcctcctcttcctgcagggctgcctgcaaggaggcagagagaatggagaggcaggtctgtctgtgggctgtcaggtgagatgggtgaggagggagcaatgggtgggctagggcagggccatggaaagtgggatgtatggtcactccatcccgaggaccagcactggaggagaaggagagcagcattatccagggaccctgctgctttgctacagatagggtagggagggcttgcccagagaggcctgcctgctttgaggtgtggagataggtgggctcctccaggcccaaggaggcagacaaggggcaccagggaccctggcacctatgtgtgtatatctgaggaggggtctctgcatggcagggtgcctggctttactcactgcctctctggccctgtcagctcctctctgtctctctcccttgctctggccatgtgtctctccaaccacatctccgcctgtgccaccctccaggtgattcatcttcctcacccccacgcccagggggagggcagggcaagaccaggccaggatgtgctgagcagggcagggtaagcggcacagctgagtggagaggagcgcctcctccatcctggccaggccctgccagcttaggtggggaaggaagtgaggaacgacacccaaagcaaggtacagagttggggaggggcgctcggcctggggcctggggcaccctgttccctcagtgctgggaaaggaccctgatctgagtcccctggggtggacctggctgggatgtagccaggggtgaggtcaggggcctagggaagctgctggaaccctgtgggttgggctatttcttccctccgggactgggagacctaaaatcccctgtgactctttctgcctgtgtgaccctggaagggaggctgcagaggtctttgtgtgtgtatgttttcacagcagagtttgtatgtgactatttaggaggaggcaagtgtcccacagtgtgtgtattcctgggcctatggctaagacccagggacaccgtggatgtgtttgttagatgagtatgacatagtaaatgacagttgtcccttggtctccatggggaattggttccaggacagcctgaagataccaaagtcgccaacactcaagtcccttatataaaatggcatgttgtttgcatataaactatgtgtatcttcctgtatatatatatatattttttttttgagatggagtctctgtcgcccaggctggagtgcagtggcatgatcttggctcaccgcaacctccacctccctggttctagcgattctcctgcctcagcctcccgagtagctgggattacaggcatccaccaccacacccagctaatttttgtatttttgtagagacagagttttgccatgttggtcaggctggtctcgaactactgacctcaagtgaaccgcccgccttggcctcccaaagtgctgggatcacaggcgtcagccaccgcacctgacccttcctgtatactttaaatcatcgccagattacttataatacctaatacaatgtaaatgctatgtaaatagttgttatactgtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatgaccatcatctcctctagagccaaagatagaggtggctttaggggacatacagtgagggaagagggacagtataaaaaggcctcccctttttctgaactggctgcttgatttaaagttattcctgtgacctgaactctggatgttgcacgtgtgtgtgtggcagaggtggaagatgcatgtgggtctgtgtagatgtggaagttgaggaaggtagtacagattgctgagaagttgggattttctttttcatttttcttcttttttttttttttcttgagacagcgtcttgctcttttgtccaggctggagtgcagtggggtgatctcagctccctgcaacctccacctcccaggctcaagtgatcctcccacctcagcctcccaagtatctgggaatacaggtgcacaccacactgcccagctaacttttatattttttgtagagacagggtctcactttgttgcccaaactcatctcaaattcctgagctcaagcaatcctcccttctcagcttcccaaaatgctgggattacaggcatgagccactgtgcccagccagaagttgggatttcaagaagcaaaacttgctcatgaaacacaatttcatcatttttaagcacacttagctgcacaaaattgtaaacaagaaagtctagatattctcagggccttaacaaaagcgttgaagaatggtttatactcagcatacctatgtggctgtagaaacaagggctgcaaacgcatgtataaactttagggtgctcacagccacccccagcctggttaaactccctagtgatactgcctgctgacatacatggaatcaatgcactagtcacaaagaattcttatctattgatgaaaacagccagccccagccctgggtctggctctccatctgagggctaggataggggcttcccagaaaaacactgtggccaggaaaggggctcagagaaacccaataccccagatagctgctaagacatgccagtcctaactttaaccccagtcccctttgggttaaagtcagttacttcacacccattttctcccttcctgcagggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacagggtaagtggtcctggaaaagagcagagaagtggcccaggggagggtacagaggaggggagaagttagccagtggcagagaagagggtttgttagaaggatagggagccaccatgctcccagggcagtgctacctacctagtgcacagagtgctgtggcctgaggctaatgtgtgcatactgtgatctcaccttagcccctttgtgtctacctcaggcaaaggtgcagattggtgtttgtggaaggggttgtggcctggccatgacagccagccacctccaaatccagctttttttttttttttttttgagacagaatctcactctgtcaccaggctggagtgcagtgacatgatcttggctcactgcaacctccgcctcctgagttcaagcaattatcctgcctcagcctcccaagtagctgggactacaggcacgtgccaccatgcccagctaatttttgtatttttagtagagatggggtttcaccatgttagccaggctcaaatccagctcactgatgtctcccttctctcttccccattcgtctctccagtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaaggtgagtctggtccctagggcaccctctaggggaaagggggagcctgggacaggaagggatagtcaggagaggcctctcagtcaagctcataccctgcttccatgtgtgtccaccacccacctcagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggaggtactgacctgtgttcaccgagaggcaggtccatgtggagaacctggaagcgccttttgtgcttgattcttcccctagctcagtatttctcgaaataggaccttgtttccaagctctgtgacactgggcaagtcttttccctttctgcttccctaccataagcctcagtttccttatttgtaatacggaaagtctcttacttacatccatagagacttctcaacagctggaggaggggcgcaagagctagagccctgcaggggcccgaggctgtgcagatgaaggctcttggcagcagagacccctttctgtgcccgggcagcctaacatttcttcagaaggcaccatcgcacttgagttagatctcagccggaatacttgctctgctaggaccaagctcaagtgtaggggccaaagccagggactgccggcatggcaggtagtcaacacatatatctaaggaataggaaactaggccaacaggcaatgagttttatacgttcttatacttttgtgcttttctcacaccccaggtactcagcaagcccttgctgatagtgtactgagtgggtgaataaatgattaattaacatttatataccatttaatctgtagtctgatgtgttttatttatattaaattatctaattgtctccattaccaatggacttcagtcctattattattttgttttggttttgtttttgtttctcaccagcctctacattaaatagattctattattatctgtatttatggatgaggcgtcctaaatacagagctgttaaagaacttacacaagctagtgaatggcagagcttaggatttgaacccaggaagtctgacttaccatcccacatgcttaaccactacactctgctgagtgaatagagagagcgggtgaatgagttgttgagtgagggagtgcacgtcatcagaatggaggggtaggctttatggtagactggggactcagggatgaagctgaaggacttacagatctagagatgggggtcaaggttatcctagggtggtattaggcttagagtggcatgggaactgttttaagaattctgggggcttgggtgagggttacgatagaggatgatggatcaggggttactgtttctcctttccagttgactgtgcagcaaaaggtgtttcacattgccaatgagctcctgcaaactgagaaggcctacgtttccaggctccatctcctggatcaggtgagtggccccttgggggtacgagggccccaggaccttgtaggtgcgtttcaaggaggcagtgatagggcctgagttcaatcccaccattgtggccagaatttagaggcagtaaggctcctctctgaccttgaagtcagcttgtccctgaagccatctctgattatgccccaagcttgatcagtgagggctgataccaaccctcactcctaacgctgggcaggtacaccagccctgactgcgactctgacactagtactgacttggacccagatcctgaatttatccctagctgtgaacttcattctaaccctggccctattccagatcccaaatccactagaatccctgagagtagagatttttatctttgttcactgctctatcttaccctctatgacagtgcctcgcacacagcagacattcaaaaatattcattaaatgaacagatctaattccaactttctctctgaccctgaatctaattctaagcctgaccttgatcctgacttctaattgttccaaagcctaactcttggcagcagggacccctttctgtgcccaagcagcctaacatttcttcagaaggcaccctcgcacttgagttagatctcagccagaatacttgctctgccgggaccaagctcaagtgtgggggccaaagccagggactgctggaataacctgaaatccatctccccaatatataaccctaaccccattccctgtctcctcagtctcaagaccaatgctgatcccaaagctccacaagcctccccacaaatactgccctcacccttcaccagccaagccccaggcccagctgggctgagtgcttctgccctgccccacaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatggtgaggggccctagacctagactgcccactcccctgtccacctgcctgccgagcccagacccagaggtgtacacaagacttcatttctgcttgctcttcctcttagtgacttttgaaaaaggaatcagagccgggcacggtggctcacacctgtaatcccagcactttgggaagctgaggcaggtgaatcacctgaggtcaggagttcgagaacagcctggccaacatggcgaaaccctgcctctactaaaaacattaaaaattatcctggcgtgatggcacgcgcctgtagtcccagctactcgggaggctgaggcacaagaatcgcttgaacccaggaggcggaggtgtggtgacccgaaattgcaccattgcactccagcccaggtgatagagctagactctgtcttaaaaaaaaaaaaaaagaaaaagaaaaaagaatcaggcccaagctctgccttcgaggacctcccagtctgatgtggaacacagaccagaactcagaaaattgcaacagaatagcatagcctacaggagtatgaggttaggagccaaattggctgagttcaaattccagctgtgccacttgctagctttgagcaagtttcttaagttgctatgcctcagtttcctcatctataaaatggggggaaataataacggcctaccttgtagggttgttttaaggattaaataacttaatacataaaagagcttagaacagtaccaggtataggccaggcatggtggctcacacctgtaatcccagcactctgggaggccgaggcaggcggatcaccaggtcaggagagcgagaccatcctggctaacacggtaaaatcccgtctctactaaaaatacaaaaaattagccgggcatggtggcgggcgcctgtagtcccagctactcgggaggctgaagcaggagaatggtgtgaacctgggaggtggagcttgcagtgagccgagatcgtaccactgcactccagcctgggcaacagagcaagactctctcaaaaaaaaaaaaaacaaacaaacaaaacagtaccagatatatacagtaagtgctcaatggatgtaagcttttgttatttttacagtgctatgatagagcagagaatgggaggctgtgggaatccagacaaatggaccaagcctagcttggagattacagaaggattcagggagaaggtgatgcctaagctgagtcctgaggtagaagggcaaggtttacaggcagcctctcaggccttcttccaatccagcctttagagtccacaccatttgccagaacggtctctctaaacaagtcagaccatgtctctccctgcttaaaatcatgtccacattccccatacctacagattctccacacctacagagtcaagtgtgtccccctcaccagactgtgaccacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacttgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctaggccagacctctgaggcaggaccccaagacttaattcacagggtcggccttccattgccacatgattgaaatcccagaggagaatctccaaactgaaaggcccacattgaggttctgaagtgagaccccaggatgagatcctccttctgaatgttctctttgggtattcaggcagggacctctaagttgagacccctgcctgaatacctgtagagaacattcagaaggagatccccaacctgaacttcccaactggaaccccagagtttgagtggcatgcccattatgatcccctaaaggaactcatccatttcctagatcgagaccccaaggctgacccctagactcacccccaaatgaagttgtaccaaatgagaaaggaaactgagcctgaaacctcagggactgagccaccaagctgagaggccagactgacccctcaggccaagcccacatcacagaatctccacagctgagctccccagaaagagccctggctcatcaattttccatcctccagatttagagctttcctccatgtccgccagccactacccagaatgaacctcccaaaagaacctccaaattgagcaccctagactggaccccaaattttccacctctcaaatttggatctctaggctgagatacctcctccccagactgaatccttacacattgaaccactagaaaagtcttctatcccgattcctccagtatcaacctgaaccccacaccccagatagagctccccccgcctaccccactttctcttccccagattttcattcattcattcattcattagtttaacagctacttactgagcacctccatgtttttgtgcattgttctaggtactggggatatagaggtgaacaaaacagacaaggtccttgatctcagggagcatatattctagtcagcaatgagacacagtaaacaaaaataataaacacacagtagaggccgggcgcagtggctcacgcctgtaatcccagcactttgggaggccaggccgggggatcgcctgaggtcaggagtttgagactagcctggccaacatggtgaaaccccgtctctactaaaaatacaaacattagctgggcgtggtggcgggcacctgtaatcccagctacttgggaggctgaggcaggagaattgcttgaacccaggaggtggaggtttgcagtgagccaagattgcatcactacacttcagcctgggcaacagagcgagactccttctcaaaaaaaaaaaaaaaaaaaaaaagagctgggcgtggtggtgggtgcctgtaattccagctactcgggatgccagggcaggagaatcactcgaactcgggaggcagaggttgcattgagctgtgattgagccactgcactccagcctgggtgacagagcgagactccatctcaagaataaataaataagtaaataaatacacagtagaatattagataggtgctgagtataattcagagaattagaagagggtggcatgacagtggctggagagcctacttgagattgggtggcctgtctgactagaagacagtgagtcaaaacctgaataaaaagaaggtaggcacatgcctgttggggttgagcatgttccaggcagaggccacagcaagtatagggtccaaggcaaggggagatattaggggaggtggggtgctggacaggttgcatatctctggatcaggaagaaggtcagtgtgacctgaacatgacaaataagagtagaatggtagaaatgaggttggagagaggagcaaagactgaaggccaagataaggagatggattttattctgagtatggtgggtagccatgggaaggtttcgatcatgattacttggggagcaagagagagagagctgagagatcagttagaagccttttgcaataatccaagtgagaaaagttggcttggatgaggacagtagcagtagaatcggtgagaaatggttggattcaggatacattcttttcagaagcagcactgagaggactagggtggagtggatgctgggcttgggagcaagagtcaggaatgacttaaaggtttttggctggtggtgatggttcctgagatgatcttaggagtctgactttggacatgttcaaagtgagctgctagtcaggcagttagatgaatctagaatttcagggagagatttggatgtcattggcacatagatagtattccaaagccataaggctggccaagatcaccaaagggagtgagtgtaaaaggaggggaaagggggccaaggacaaagctcagggatgtggaatcaccaaaggagacttagaaggagcagccctaggctgggcgcggtgactcacacctgtaatcccagcacttttggaggctgaggcaggtggatcacaaagtcaggagttcgagaccagcctggccaacatggtgaaaccctgtctgtactgaaaatacaaaaattagccaggtatgatggtgcacgcctgtaattccagctagtcaggaggctgaggcagtagaaccacttgaacccgggaggcagaagttgcagtgagccgaggtggcgccactgcactccagcctgggtgacagagcaagaccccatctcaaaaaaaaaaaaaaaaagaaggagcagccctaaaggtaggaagaaaaccaagaaagtgtggggtcctaaaagccataagaatggggttcgaggccgggcgtggtggctcacgcctataatcctagcaatttgggaggctgaggcgggcagatcacctgaggtctggagtttgagaccagcctggccaagatgatgaaaccccatctctactaaaaatacaaaaattagccaggcgtggtggccgtgcctgtaatcccagctaccctggaggctgaggcaggagaatcgctggaacccgggaggcagaggctgcagtgagccaagatcgtgccactgcactccaacctgagccacggagtgagactccatctcaaaaaaaaaaaaaaaaaaaaagaatgggaagtggacagctgtgtccactgctgtgtccgcttcccaaactgagccttctccaccctgccagatggggcactttgctaccaagcctggacccctagaaagaactaggcctctagaaagtttaatagctaagctctacaagcagacatctgcagcataagtaagtacctcattcctcctgctgaaaaagagccctcactgaggtgccagcctaaacttctagaaagggccttccagactgattgtctgggatgggccctatggactgacatctccaaactgaaccttcatactaagcccattctgaggtcccagttatagatcccaacactggtttctcaaactaagatccccagactgggcctcttcccacctggaatactcttcccacactgagccctgagagtgggttcccagtgagagccttcagcttgaggtccccaaaagagcttcccagtctgatctccttggccaccattctatagacaagtattgccaaactgagcaccctagattaattctcctatttcatatccctcagactgaaactttcagcctgaacttaaaagactgactctccaggtccatcctacagactgaagccccactgagccccaagactggattctctgagttccccagagggaaccctgaaattcagcagcccagactgagctccagacagagattccagattgtgttctccccagcccaagtcccctagactgatgacccctatttttcttttttctttttcttttttttttttttttttttttttttgagacagagtcttgctccgtcacccaggctggagtgcagtggcgcgatctcggctcacggcaacctccgcctccctggttctagcgattctgcagcctcagcctcccaagtagctgggattacaggcacccaccaccgcgcccggctaatttttgtgtttttagtagagatggggtttcaccatcttggccaagctggtctcgaactcctgacctcgtgatccacctgccttggcttccaaaagtgctgggattacaggcatgagccaccgtgcccggccaacgacccctatttttcatttaccagatggagagtcccatgatgagctccaggactaatgccctagattattagactgtcccccaaattaagccacacaggctaagtgcctagtcccatgtccacattgagcttccaggactcagttctgcaattttattttcacactggatccccaacgtaacatccccaggtgaaaattctccaaataagctccctgcactagacccaaagtgagccgccagtgaaagcaacctagagtgggctccagatagagtccattttctcaactgtatatccttgggcaagctgctcagcctctcagcctaagttttctcacatgtagaatggggatgataatgatacctacctcatatggttgttttgagaagtaatgagataatctgggtaaagctcctagcacaatgcctggcacatggtaaaggctcaataaatgttagctgcttttattactaaatgcactggctaatgcccatccctctaaaattggccccaggttgagtttaagaaatttatttattttttatttatttttatttttatttatttattatttttttgagacgtagtctcactctgtcgcccaggctggactgcagtggcgcgatctccgctcactgcaatctctgcctcccaagttcaagcgattctcctgcttcagactcctaagtagctgggattacaggcacccaccaccacgcctagctaaattttgtattttgggtagagacagtgtttcaccgtgttggccaggatggtctcaatctcttgacctcgtgatccacccgcctcgccctcccaaagtgctgggattacaggcgtgcgccaccgcacccagcctatttttatttttattttttttgagactgagtctcgctctttcgccaggctggagtgcagtggcacaatcttggctcactgctgtctctgcctcctgggttcaagtgattcccctgcctcagtctcccaagtagctgggactacaggcacacaccaccatgcctggctaagttttgtattttagtagagatggggtttcaccatgttggccagcatggtctcgatctcctgacctcatgatctgcccaccttggcctctcaaagtgctgggattacaggcatgagccaccgcacccggccttttatttttttttattatttttatttatttatttatttatttttgtattttttttttagtagagacggggtttcaccatgttagccaggatggtctcaatctcctgactttttgatccacccgcctcggcctcccaaagtgctgggattacaggcgtgagccaccgtgcctggcctatttttttttttaagtgaaagtaagtttattaagaaagtaaagaaataaagaatggctactccataggcagagcagcctgagttgaagaaattgagcttcctgttttgtatcaatcccaaccctatctgaggccccaggatgaacctcacagcttgagcttggccaactgagcttccttaatggagcctcccagattgagctccccacatcaagtccaaagatgaaactttgtccccagaaacaacttaccggtctggttttctgagctgttcagaatgagaatctctgaatgagagcccgcctgagatatgcgcactaagatcctcagcccaagatcgtaagctgagctcccaattttttacacctcagactaaattccccaggctgagcctcactgaatcatatgtctggttccccagactgacttgcccactttctactttccagactgcactctggagcctggaccctagaccaatctccccataccaggccatctggaactcctggcctcagttgcctacactgggcccaagactaaactccaaaccaagatcctagactgccaagcccagaccaggccccactaacgcttccaaaccaagcccctacatcaggccccgcagattgcactccctagcctgaacccctaagtgaaattctagactgaaatccccacactgagcccccaggtagggactgtacaccctggatccttggaaatgccagtctgtactccacatgagacatctccagacagagctcgttgtaacaaagcctccagtcagagcccatcagcctacacaggcctgagcttgtgtgcccacaacttgccagagtcttcttcctatccccttccctgggtgccccctacctctaccactcagcctgccccctgccttggggtgggggagatgtaggatgtgtaggagaaaaggcagctgggagatcattcccagctctgatgccaactctgccacccaggtaggcaacctagggtggtcaccttctccctgggtcttggtttcctcattggataaatggggcacaatcatctatgttacagggttgttgtgagggttgaaggagctaatttatccaaagcatctgcctggagagggcagtgggaccttggccctgtcctagggagctcgtagtctactgaggaatatggatgcagatgtataaatacatgatgagcactgtgactagtgggacagaagggagcaaaggagaatgtgagaacccagacagggtcctaacccagcccgagaactctgggcaggctcactggaggaagtgagctggatccagaagacagtgacagttggccagatgaagtaagacgggacatgtttagggaggtgtaggaagctggagtggtcagcagaagccacatcaccaagggctttgagtctttttttttttttttttttttttttgagacgtagtctcgctctgtcacccaggctggagtgcagtggtgcgatctcggctcactgcaacctccacctccagggttcaagtgattctcctgcttcagcctcccgagtagctgggattacaggcacgtgccaccacgcctggcgaatttttataaatttagtagagacggggttttgccatgttggccaggctggtcttgaagtcaggtgatctgcccccctcggcctcctaaagtattgggattacaggcatgaaccaccacgcccagcctcaccaagggctttgaatgtcaggctaaagggctaggtctttaccctgcaggcacaggggagccattgacagatttgagcagaggagtgacagtaaactgtgtgagaaagctccttctggcagctaggatggaataagggttggagattggagcccggcccctgaaaggcatgtggatgcctgagctgggacaggggccatagatctccgtgagcaccaaaacttggtcatgaagagagagcctcttaggaaaacacgacttggttggccagccatatggacctccttcagaagcacctctgctcctctagcacaggctgatctgagtggggagatccagcacatacagaatggggtacacaaagactgtggccaggccttaagcatgggtgggatttattagtgtgtggagatgtacagggactcatttcagctttttctttttttttttttgatgatacctggtcactataggaaatatggaaattacagaaaaagatgaaagaagtaggaaaaaaatcccctgttatctgagcccccagagaataagcacaatgaacattgtgacataaattcttcctggtgttttttagacatgtatacttgtaaaagtaagatcattctatataaacatgtttgtatccttttcttaaaacaccctgagcatttcccagattattaaaagacctacatgaggatcatttgtaaaggttgtttaatgttccattatatgaagacaccataatgtatttaactgaacccctacagttggccattttttttggcagggaagaggtacaggtgaaggtgtgctcccctacagatggacatttttgtttcccacttggaactgttgtaaataccaatatgacaaaaatgtgtttgtgtatagaatgtgtattttcctagaatagatacccagaatcagaatcattgagacaaagaacaggatcatctcattgtttctttatatggctttttctgattataaaagtaatacatgttctttgtcaaaaatacggaaaatacagaaaaacctaaagaagacaataaaaaccacccacggccccaccaaccagagacaacatgggtatgcttccttctggttacatatgtaactattattgttattattaatggtaataataatcttggcaagcttgcatttttttattggctgccaactactccatctattgtgattctggcattgtgacattggacaacttctgattttaaatgatgttgctgtggacatctttgagggtggagctttctgagatgggagggtgtgatcaggccaggaggaggtattcagggaggaaagaagccccgaggccgggtgcggtggctcacgcctgtaatcccagcactttgggaggctgaggtgggtggttcacaaggtcaggagttcgagaccagcctggccaacatagtgaagccccgtctctactaaaaatacaaaaattagccaggcatggtggcacgtgcctgtagtcccagctacttgggaggctgaggcaggagaatcgcttgaacccgggaggcagaggttgtggtgagccgtgatcatgccgctgcactccagcctgggcaacagagtgagactccgtctcaaaaaaaaaaaacaaaaaacaaagccccggaaaggctcctctctgctagtcccccatctgacctcacccctctatgcctgtagagtctctggagctgatcgccacagcagcagagcactcgaatgctgccatccgcaaaatggtgagtggcccttctagcccctgcccttccttggccacccacctgtggtgtctccatcctggagtgggggtgtcgtgacttgtgggcatctgacaggaggctggcaccccaaccgtgccttttgttccctgtcttttgccaggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactagtaagtgccaggcatggaattgtgggtgggtcatgcccctcccaacacacacacacatagtgacctggtactcactcaaagactatacctcctttcattcctgaaagaggaaaaaaaagaaaaacagactatacctcctgctagtcattctctcctctagtaacgaattgtattttcactacctagctaggattttttttctccactttacagatgaggcaaataagccttgcagagaagtgacttgcccgaggttccccactaggaagtgtcttccatgcctaggctctttccttgtgacccctgtgcccaatttgggctgtcttttctccatctattgcctacagtccttggcagtaaagcttcagggcaaggagctgggccacatccccactaggccctctgcacatacatcccaaactttttccttcctagttcaacgaccgcctcctttactgcgtgcccaggctgcggctccttggccagaagtttagcgtgcgggcacgcattgatgtagatggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttgttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaatgcagtacttggtccatgacagaagcctggtttgggaaaaagagccctaaaagacatttgtgggacaataagagaaaatgtggatgtaaagtgaacattagatattgagaaattattgctgtcttaggtgtgataatgttatggtggttatgcaggagaatggccttgttttgcagcagtgcatgctgagggcttagtgtcacaatgtctgttaattactttaaaatggttcagcacccaaaaaatacatatgtaaccatacatacacatttgcacacatatacatacatacacatatacagtcatgcactgtataaaacattttggtcaatgacagaccatatatacacagtggccccataagattaaagtatcatattttactctaccttttctttttttttttttttttttaagacagagtctcactctgtcacccaggagtgcggtggcatgatctcggctcactgcaacctccacctcccaggttcaagcaattctcctgcctcagcctcctgaataagtgggattataggtgcatgccaccacgcccatctaatttttgtatttttagtagagacagggtttcactatgttggccaggctggtttcgaactcctgatctcaagtgatctgcccgccttggcctcccaaagtgctgggattacaggcgtgagtcactacgcctgtctttactataccttttctaggtttagatatgtttacatacccaaataattagtgtgctacaaattaatacaatattcagtacaactgtaacatgctttacaggtttgtagcctaagagccataggctgtaccttatagcctaggtgtgtcgtaggctagaccatctagtgtactagtgtcagtacgctctctgatagtcgcacaacaatgaaatggtctaacgacacctttctcagaacacatccccgtggttaagtgacgcgtgactgtatgtacatatatatgaagtaaatatggcaaaatataaaaaaattttgcatctctatagtaggtatatagatatgtattgtacttgtgctatcctgtttacttttttgtatgcttgaagttttttataataaacattttaaaataatagcatgggatgatggccagccatttaacagaggggcctttcatatccattctctacttcgatgattataatcatagctcatatttcctcaagacttagttttttgccaggtgctgttttaagttaatgttaacttaaaattttaagtctaagttgactagtcaaaagcttacaagagccctagaagtagctactgttaccataaatctactttacaaatggggaaacttaggtgtaggacagttctgcatgcagggcgcagtggctcacgcctgtaatcccagcactttgggaggccaaggtaggaggatcacttgaggccaggagttcgagaccagcctgggcaacataacgagacctcgcctcttaaaaaagaaagaagaaagaaagaaaaagaatatttatgtacttgcccaagatcccagagcaagaaaggagcagagctgagattggagctcaggtcatccggccctggagtccacattcctaaccactgtctatgctgccttctgagggaccaggtgaaagggtatcagggtcatggtgagggccagaggatggatgcatgtcagcagatggcctgcttctgacaggctgtgagaaagtgagaaatgactggctgggactgcaaggaggtgggagagagagatgaatgtgagatagagggtatcctcctgggggatgaagtgagtcttgaagcttggggagattgagagcctcatggaggcctgcagcagggaaagtgagagcaaagcagatgccctgcacatccaggggagtgacaagccacgtgacagggactcatcatctgcagagaggaaaggggctgcagtgggacactgggcccagaaggggcagccaagcaatgtaggatttcctcctagtggcagcaggaaggcatggagggtttgctttgctttgcagtcacttttactgcccttaaaagaaaaaagaaatttaatgcaaattttcaaatatccggaaaagtgtaagtacaacaagcacccagatgcccacaacttagacagctgcttctcaactttggcaacctttggaatcagctggggagcttttaaaaaatacggatgcctgggacccacctgcagagattctgatttaattggcttgggggatagcctgaacatggagagctctaaaagccccccaggtgattttattttactttttaatttttatttatttatttttgagatggagtctcactctgtcgcccaggccagagtgcagtggcgccatctcggctcactgcaacctccacctcccgggttcaagtgattctcctgccttagcctcctgagtagctgggactacatgtgcatgccaccgcgcccggctaatttttgcatttttagtagagacggggtttcgccatattggccaggctggtcttgaactcctgaccttgtgatctgcccggctcggcctcccaaagtgctgggattacaggcatgagccaccacgcctggtccctaggtgattttaatgtgtgtatcagggtgtacaaccacttatttaagagtcaacaactactgacattaaatgtcttttgctgaaccattttaaagtaaattacaaatatcaggacacttcacccctatacacttcagcatgaatagccaaaaaactctactatactgtagttcttttttttttttttttttttttttgagatagggtctctccctgtcatccaggctagagtgcagtggcgttatcatggctcccttcagcctcgaactcctgggttcaagtgatcctcctgcctcagcctcccaagtagctgggaatacaagcatatgccaccatgcccagctaattttcgtattttttgtagagatgaggtctcactatgttgcccaggctggtcttaaactcctggcctcaagcaatcctcccgcttcagcctcccaaagtgctgagatgacaggtatgagccaccactccgtctattgtggctcttaaaaataaaaagcaacacttgttcacttctaagaaattataaattagaaaatatagataaataaaatatttcttttttttgagtcgcagtttctctcttgttgcccaggctggagtggcagcaatggctccatctcggctcactgcaagctccgcctcccaggttcaagcgattctcctgcctcagcctcacaagtagctgggattataggctcccgccaccacgcccggccaatttttgtattttcagtagagacggggtttcaccatgttggctaggctgacctcaggtgatccagccgcctcggcctcccaaagtgctgggattacaggcatgagccgctgcacctggccaataaaataattttttaaaagaatacaatcagaataggccaggcacggtagctcacgcctgtaatcccagcactttgggaggccaaggcgggtggatcacctgaggtcacgagttcaagaccagcctggccaacatggcaaaaccccgtctctactgaaaatacaaaaattagccaggcatggtggcacacacctgtaatcccagctactggggaggctgaggtaggagaatggcttgaatctggaaggcggaggttgcagtaagctgagatcacgccactgcactccagcctgggtgacagggcaagactccgtctcaaaaaaaaaaagaatacagtcagaataaagtgattgcagtgcagtgcagggcagacagaagagtcagggaaggggaacgcacactgattgagcatcgagtgtgccagacattgtgctgagcactgtacacgttacctcggttactgctgagaacccagagagtgataatcattatctccattttacaaatgaaaaaaaaactaccctcttttctcaacttgacacccagcaacagagaattttttttcctttttgagacagagtctcactctgtcacccaggctggagtgcagtgggacgatctccgctcactgcaacctccgcctcctgggctcaagcgattctcatgcctcagccccctgagtagctgggactacaggcatgagccatcacgcccggctaatttttgtacttttagtagagacagaatttcaccatgttggccgggctggtctccaattcctgacctcaagtgatccacccgccttgacctctcaaagtgctgggattacaggtgtgagccacccacacccggccaactgataattattgacacggtttcttttatgttctatattctctcccacacatttcacccttacccctctacctgaggcctagcacctccttgaaaagtcctcacccaaacttcagactggggcatgtcacctcctctgggctccttggccttattttcaccatcaaaacactgatctccctgtattgtccctgtctatttcctctactagaccatgagctccttgagggcagggtcctctctgaagctcaagttcttagcacagggtctggaaagtattagtaatcgttgaataaataaacccaggcagattatgtgacttgcccaaggtcatataagtaataggtgaagaagagggtcaagcccaggtctttctgactccaaaacacctgctcttccactcctattgctttttgtgggcctacctaaccaaacatctttcttttttattccccaccccaaggactgaggaggagaagaaagactgggtccaggtaacatccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagcccatccccaccccatgataatccaagcgttggagcaggaacaagggctggctggactgggctggggagtagctgtctctgacctgagacctggccctccctacagaacgtggatcttgggaagcgggcacctacgcccatccgggaaaaggaagtcaccatgtgcatgcgctgccaggagcccttcaattctatcaccaaacgcaggcaccactgcaaggcctgcgggcatgtgagtgttgggaggcaggggcagagctagggaggggacagaatggcagcccaaaggcccactgcagagtgggtaccctccaagtggggggaggccacaagtctgctgtgggagttggtatgctgaagggaagacccgctggaatcaggctactcttgcccacttgccaccccaggtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcc

SEQ ID NO: 3424 - DNA, 11320 bp, human
tggagcttgagcaggagctggctgagctgcaccagaaggactcagccctgctcttctcctcctgctttgttgccaatgactctactctcttcaccttggccaagatcctgccaggtaagcctgaggcctgagctttgttcagggctggtatcctgcaatacagcatccagtttcactggttccatcactccttccctgtatttggagttccctcactcccattgttcttccttcttatccaccttgcatatcctcaacactggataattatatccctctgctttctctccttctgcacgtagagaggaccattaccggggaacattaccccacctcacagaaaggaaacactataaattcatcacctcccaactcaactgagctcttaacacacatacatagttattttatgtctccacaggagctttttcaaacttcttctcctcttctaaaacctctgactaccttctcctccacacttagcaaataacctcacatcttacttcacaataaaaacagaagccccagacagagaatccttatttattgccaccaaacctacgaacttatctaattgtttatctagccttgcctcattctttccttttacaatggaaggcatatctctccttctgcctaaaaccaatcccttcacttgtacactggttcccatattcccagtctcctactctctagtctgtaatgtcctcacctcatacgccttgttgtccttccgccaaggcccaatccagaatgaatacaaccctccatcttcactatatcaattccgggctcatacagttgctcagacaggagtcactaaaaattcatactcttaacctctactgggttctccatggtctctgacaatcccatttccctggtcagttctcgaagtttatggggcagttttgccaaaccaccattatcctcagccttcccacaccccctcctccccatctccctcagcagacaacttcatgttctactacattcaaaatagaagataccagacagcaatgtccttgactcccagccacaaagcacctacaaactcataagcatcttcaaatgtcctctcctcactccttctcttctgtcatagtggaagaagtatcctttttcttgtgactaatccttccactgttgctctgtgccccattcccctctaccaccttaggaatcttgacctattggctctctcctcctctcctgtatcttcagcctctccctctctttaaacatgttttcaagtctcttgtatcttataaaaaaacattgcctcaacccctgatcactctctagctactgccctctttcctccctataacaggcaaactgcttgagagaagtcttcgctcttactatctacttcctcacctcctgctgattcttcagcacagcaaaaatattaccaccacttctcagaaactttttttgagtccacccataagccccaactaaactcaacatctttaagttgtttttagtccatcccctcctcaaccattaaacttctttccatctctactgccagcatcctagcctgatccaacatcattttttaaagaaaattttacctttgccctccgataatctattctttacaacagtcagaattttttttaatgcaaaactatctttgtcaccccaccctcagccctggtcaaaaccctttagtggacccccattcccccaggaccaaatccaaatttcttatcacagcttctaaagttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggaagttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagcagatgctacctggaatggatggaatttcatctagactaggaacaatctagcatcagtccgagtcaacaaacattccctggggtaatccctttttcaagtcttgatcttatatattggggagaaggaaaataggtcccgtcctcaaaaaactctgaagcttcttgggaaattaaatgttcttccaccccaaggcagtcagaggctagaccagggttacaaatgactggagggaaggatgtaggggtcagaatttgggaacagtgaagtccttccaagggagaaagaagtgtcacaaaagttcccagagaaggaagaagcagagcaaggtcttcaaagggaagaaagggttggcccttttctttgccaggtcaaacctgaaggttgaagtgggagtactgggacagaagcttaaggattatacatctgcttcctcagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtatgtatatgagtgagtgtatgtttactagtgttggtctcacaaaaaccatgatgatcatgatgatgatgatgacgataacattataacagctaatatttatagtgtttattatgtgccaagcaaaattattagtattttacatgtattaattcatttaattttctgaacaattctatgtgataggtgttattattattttgattttttacatgaggaaactgagacataagagtaatttgtccaaggtcacacagctagtaaatgccaaagaatggaggcagctattacattcatcttataggtaaagaaactaaagttcagagttggcatccaattcatcttgagtggctcagcaagttggtgctaaagtgagtatctgcaccctaacacatataactccaattcctcgagtaacacttctcttgttagaaatgatatgtaaatcaataatcccagtgtttggtttttatgaaggaaatttcaaaaaccattgcctaggatttttttcaaggtccagtatgaagcattggggtcaaaacaggttttcaagtcagagagacctgggttcaaatcccacctttgacagttactggctatgaccatgggtaactctttaactgtctaagcctcaattttcccaaaggtaaaatatctggttgtaagaattagagatgatagaaaccattctagttattatgctttagtagaattaaatgatcttcacactcctacctcctttctttgctcaattgaaacaatgtccaaagctttctattgctggccctgttgtgtagaaatcatgtgttttaggcatcctcttatggatttatttaagggaagaggtcctcaactcatttcagtttgtcccttttccaactgaaacaaaagagtccatagtattccctgatttaggtatcttaagtggcatgtaatgactatacacacaggctctaaaaccagactatccatgttcaaatcctagcatgaccatttactagcttgggcaagcttcttaattgctctgtgtctcagttctcagttgcttatttgaaaaatgtaagtgataataattaaataggtatgcaaattaaatgagttaatatatgtaagaaacttactattatgcccactcccacatttctaacactagcaataaagtaaaactatcctatcccttttgtatatttctaccactgagactattcaaattcattatttctctagtggaaactatgttggtaccattctacctcgttacatttgcaaataaatagttatttacctatttttggggtgcaaactctgcccaaactgttgatccttaggctgaatctctcccattgaaatgatgctaggctgaacacagcagaaacaggaaaatagacattgtcagaatgaagtaaaaacagaaagacaaagagtcaagccttgatcccaggctggggaacacacacacatgcgcacacacacgtacacacacacacacacacacacacacacacacacacacacacacacacacagagagacagagagagagagagagaaggcagggatgagatacaggcaatcgatccatacacagaggtttgtaatagttctaaatgaaggcgcacatcctccttcctctctacaacacccttttccaacccaaagtaggcatgtatgggaaattccacattggagatggagctggggaagggttatgatgtcctacctctatcccttggctttgctcaggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggtaagtgaatgctttgggccttcttatataccctccagagaggaggcccttacaaaattcttttctgcctcctccccaaagctataggggttgtttggacagaattcacagccccaggctgctgccatcctggactccctctctccactcgcatcccactgcagagttgatgagaaagtctggtagagttttttgaaaagaccttgaactaggccaaatagttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccaggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaaaaagaaaagaaacagaaaatgttggagtacatcacatactaagggtatcatcaatttgtgaaaaatttgtatgcattttgggtatttgcatatacacatgtatgtgtatgtgtgcgtttatggtcacggtgtaaaacgtacttcttattgagaaatgagggcagaaaaataaaatcaaaagccataggattagctgctactttggatcctcaatatgagcatttactgcctttaaaaatgaactgctacttctttcttaaataacacgtatttgtgtgagtcagtaagccagggcagggaaaggacacttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatggaaaaaaaaaatctatcccaaaattcagtgatgttccctcatctagttccctccatctgcttaatggagctagtgatggtggagccagagtggcaggtactgattagcctttctcctgagtccaggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtaagttctcaacatgggtgcctacaggacctccctcccctcagccccaggatctgaaagagaagctgagaggacagagaccactgagtttacaaaatatttctggaacatctaatgtgtgccagcacctatactagggtcacaaataaatgagaagcagcccctacacttgtagggctccagtttggttggggataccatagtgaacacaaacaatgacactaagggatgatcaaagctccacaaggcagtgcatgatagagttgtcggagcagagaggaggggcctgactcagcctgagggatgcaagacccacttcctagtagaggtgacacctgagctgagtcttgcaaagtgagtggtattaaaagaaagagggcatggaagaagtattcctaccagagggaagagcatgaagataggtgaggagaatgagaagcagccagggatatatcaagaacaataagcaggtggtattggaatgtagggtcataggaatggagtggggcaggggagtatcaatctatgagtctacaaagacaacatgagatagagactggattgagaggcttgtagagctgagtagtttgagatttaccctgaaaatgccagtttagtcaattcacctaatgtttgttggatttctgttgggtagttttgtttttgtttgtttgtttttgtttttgtttttttgagacagagtctggctctgtagcccaggctggagtgcagtggcacgatcttggctcactgctacctctgcctcccgggtcctggctcaagcaattctcctgcctcagcctcccaagtagctgggattacaggcacgtgccaccatgcctagctaatttctgtatttttagtagagatggggtttcaccatgttggccaggctagtctcgaactcctgacctcgtaatccacctgcctaggcctcccaaagtgctgggattacaggcgtgagccaccatgcccggcctgggtagtttttaatgcagggcctgacattgaataggtgctcattccaggcctgttggatgaaagacatgtaggcagttgatggtctagcagaggagccagatatagatggtactggtccagtatgatgagctccagtattctgggagctagagggagtggacacattatggagagagagggtgggaaggatgaaattggagaggctttgtgagtaaggaagtttttatgatgcatgttgaagtacatgtgaatatgttgtaagaatattccagaataagggaattccacgagcaatgacctagagataggaaagcagtgggtatgtattgacaacataattctgtttgtctgaagcatgggcagtatgagaattcaaggaagacaagctaggtaggcgccattcattcattcaaaaacattaaataatgctggctaacattaagtacttaccatgtgccaagcactgttctaaacactttacacgtattaactcatctaatccccacaacaacctcaagagttagagatcctcttatcatttccattttgtacatgtggaaattgaggcacaaaaatatatagtcgctgatccaaggtcacacagcttctaagttgcaactgggaggtctgtctctacctccatggtcataactgctaggtctaccacctctctgagctgatgacccagactcctgggccttttgttcagtattctcttttgctctgggcttcaattgtagagctctcagtattcttggttctctgaatgtccacctaggctaggcttttgtaagaatatatgaggcatccacgatggctccaccagtccctaagttccatagccaatccatcctgaaatcctgcaaaagttatctataatctctctcaaacctatttgcttttctcccctgccacttctttaatccatgtcaacatgatttttttcctaatttctctgcttctctcttgctcctctcaaatcctttctcgatgatgaccactagagggatttttctaaaattctgactatattgctcccttgcttaaaccccttcatgtttccctctagactctaaagcagtgacctccaaggggtatgcaaaatgattacagggtgaaggaacagaatatgtattagaattttatgtttttttatcttaaaaataggaaatcaagcatcactgatactgatctttaatatacagactgacagttatacatgtatataatatataaacaaatatagagattggaggtacatgctaaaacatttgtactgatagggatgtatagtccaaaatttggaaacattgacatataggacagagttgaagctcttcagcatagcattcaatgccttccacatggtgatctctatgccctcacctcctccccacatgcattttgttttttcagctacactgaaggacttgtcgttccctcatttttttctgctctcttacctctgggactttgctcatgctgctctcttttgattggaatgccctccctcacactttcctctggcttactttccttcatcttgtagacttaacttaggcattctttcaacaaatatttattgagtaccaactgtgtactagatactgttctaggcactggggatgcagtagcaaacaaatcagacacaaaattcctaccctctggagcttacattctagtggaaggggtagtaaaaaaaattaccaaaaataagcaaattaagtagcacattagttctaagtgctatgggaaaaaataaagcaggataaggagaatgggataaggggccaggggcgagttcagagaagggttgtagtattagagtggcaagggtagaagacgctgaggtgaaacttgagcaaaaatttgaaggaggtgaagttagtgaggcagatatctaagggaatggcatcgcaggcagagggaacatcctaaggcagggaagacacaggagtattccttttatatttgaggaacagtaagaagatgggtgtgggtggaatggtataagcaagtgggagacagaaaaattgagtacatagaggcaatgtgggaccagattgtatagggtatggtaggccattagaaggagtttggcttttactctgagagcccttgaaaggatttgaacacaggactgatatttctgactcgggttttaacaaaattgctccaacttctatgtagagaatacactaaaagggagcaagggtggaagcagggagacccaagagtgggctacagtaatatcccaggtgagagatgatggtggctcagacttgatcataatgaaggcaataagaagtggtcagattttgaaggtagagccaagggtctttgctgatagatgggatatagggtaagagagaaagagaaaaataaaggatagctctgaaatttttggactgagcaactggaattgccatccactgagatgggaaaagctaaaagtagaatagcttggtggagggtagggacatgagtagctcagttgtactcctaagttagaaatgcatattagacatctaggtggagatggagaaaagccattggatatacaagattggaaaccagtagagtggcgtgagctggagattaaaatttctgaaccatcagcatatagatggtctttaaagtcatgtgactagacaagatcaacaagggcatgaacacagaaaaggccaagaacagagccctggaacgtacctggggtacttcctccagctaggtcaggttcccttctctgggttttcacacccccaggtggaccccctaccccaggtttcctggtcatagcaccaatgacacagtatagttactgtcattatcattgtcctcatagggcttagagttcccaagcagacagtcattcttgggccacagcacatcctatacttagggagtggtccaggccaggacagtatggcttcaaattgtgtcaaaggagagcttccaaatcttttataatatatatcccagcatccagatacaaatggtaatattcacggcacacacagaagcaaacagtaggctacttctggccctgaggtatcttgaagggttgagggggatcaatatcttggctcatctgtactgtgacagatttggaagatctagtctaacccattttttccctcccctccccctaccaccttcagagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtctt

SEQ ID NO: 3425 - DNA, 21888 bp, human
acctgtcattcgttcgtcctcagtgcagggcaacaggtaagagctgctttcagcctggcaccctatctctggtctgccagctggtctctcagggctgtacacactgactctctggtctgagtagatctgactttttcctttgtttgtttcttagaatctgtctctttttcattttctttttatctcccatgtctctttctgtctttcctcattttcagcttttttctctctttttcccttcgttactttcttttgttagttttcaagatcattcatttcatttcatcattctctgacactcttgctttctcttatttttccctctgaattctaactatctttttctctaaatttctttctctccccctttttgtctctttcctcggctttgtatctctccgtctctgtgtttctgtctctctcttcctctctatcaagaacgatggcttaatatttcttcctgcaattccccattcctctctccctttgactccctctacctgctgggctgacagcagagctcagtgggtcagagcccatggggagcctaggggtgggggaagagctagggagggaaactaagaggatgtgggggtgatgggaatgatgaattgggtaaggagagatttggggaattgagagatgaataattagcagaaataagtgaagaaagtggaagaggaatgtagtgtcactatacagaaagtaaacagatttctattctcatcctaattcactgtgagaccctaggcaagtcattcactctctgaaaaaaaggcttggcctgtaatttccaccaccctttctagttttgattttgtgatcttctaaattttcctgtttctaagaatttctgattctctgattacagttatctaaagttctgtatgattctttcatggtgggaaaggggtactaggaagagaagtaaggcctgatgtttccaactcctgaagagaaattaccacttcccttccagacctaattgacttttgcaaagcaggccacaaaaggggtgggggggtgggggacaaggaatgctgcaatgagtgttttctggctgtctgctggggtagagttgcagttggcccttttcacctctgggagtacagattgggtgctgacacaagagaggattttaaagtcgtagggaaaaactttcagtaatgatctgttacttggtctcaaatttcaccatcatctctttggttaaaagtattgttttaagaagatgcctggcaagcattatcacacattaggtacataagttattgaatggtagagtaaatgaatattcaacagtacctgaaattccactgtagttacagatctgttcctttggtaaggcattggtgacaaatggcatatgacctggaaagaggcctatgttagtgcagcagaggagataaatgtctagagtcaggccctcagtcaagaaaaaaaggtagtaatatttgaatcacagatccataatggttaagttaggaatctctggaaacagattgcctaggttcaaatcctgcttctcctatgtactagctttctgatctagacaggttacttaatctttttgggattcagtttccctatcatcacagggttgacatgagaacacggcctggcacagagggctctgtaagtgtttgactatcagaactaggcggaatctatgaaattatctagtccaatgtcagtggagaaacggaagcccagagaggggaattacagagcccaagttcacacaataaattgtaacaggattgggacaagaatcaattctctagcttcccaaacccagcctggtatattcatgtgacttcccttggctgtacgttcattttttctacatgggaaatggagaaaataaaaataataaagtctatcaattaaatataatatttaacacttttttactgtttactctgggataggtactctgctaaatgctttatatggattatcttactgaatcttcacaacattcctgtgatgcagattgtccttgttattaccaacattttccagatataagatgtacagcagggaagtgacttttctaaggtcccaaagctagtgagtggtggagccaggattcaaacccaagtagtttggctctagagcctatactctttataccctaaattgactaaaatgcttccttgattcaattttactcactctagtctcttggtaggtaatgagatggaatagaaacagagcccatggtaactagactacaaggtcatgggtataatgatggccaggcagagtgaggcagagcaaatttcaggaaaggagtaacagaacaagagaaatgagaacaggagcttgaaagaacttgagaattcaacaaattccaagaagtggtctatattttcccaggaccctgagcatatcatggccaaaagccccctagtaatgatgtgtgttaatttctcctgtttttatatacaggaggtaggtcttctccaccatcccaaggcaggactggactttgcctccaatattgggggctttccttcccactacataccccaatgttgttggcattattgttgccagtattgatgttaggggagtttacaggagcctggagccttgtcatctgccttgcctgcacttctgggccatccatttcttaccaccaatagccagggccagctctagccagatgctcagacgtgattccaggaaggggctcctcttctctcccacgccctggtctcagcttggggagtggtcagaccccaatggcgataaactctggcaactttatctgtggtctgcaggctcagccccaagtgctttagctttcacaagcaggcaggggaagggaaacacatatctccagatatgaggtaggcactggatccaattccttacctaccttgtgaagtggccataattacctcacgtttgacagctgatgaaggccaagatccagagaggggaagtgatttgaacaagaacatccaacaatgaaattggagagctggaattttaataagaaaagctaacatttattgaagatttactatgtgccaaaaactatactaaaggcttaacttggattgtttcatttagtccctccaacaacccttctgtcttttccaatttcagggcccacatgccttggccccacataccaacccaggctgctgtgacagcccatgagagggggagaggttgctctgggatggaacaagaaaaagaggttgttttgtgaggtacggggagggtgcttgttctatgagatcaggaagggagggagatgaaggaggttgccatatgagggcagggccatgagctgacctgtccctcaaaacataaggctgagggtgctagtagattctactcagtaactttcttcacagtgtcagtgctttagtcttctcacattctcccatgtctctcccattgtactgtcccttatcttgtctcactttttgactctgtctttccaatttgccctttttctttacatctgtctctccttcttgctctctctagctgtctttctcttggtgtctctcagctctcacccctcttaaccctcatccccctgctttagtcacctctctgtctctatcctttgatcttgtcattttctctactctcttctctctgtccctcagtctctctctcatctccctcaattagggccatgattctcttccctaaacttacttagccttttgcaatttctggcagcatttttttatgtttgtgtctgactgactctctacccctgctggatcctctccactcctgttctcacttctatgaatctttgtataatcctctagactcattgatccctcctcatgtccctttcgtgccccttggtctatctgtctctgcctttatccctgtgtgcactatcaccaccccctttttcttttttcattttctctttctctcgactcaatctctgttttcatctctaccctgctccctttccctctacctttgatctctttttccccctcaatttctgttcttttaactctaccaccaccaccacatctttgttctctctctactttcctccttttatctttcctaaattttcttttcttctggcttttctcctagtcccttctccttcctcaatttcagactctgttcattcatcaatttaccccaaaattcaacaaatatttattgagtgcctgtgtgtcatttgctttctctttttctgatctctttgccccctttctcttctctgtcttggcctctgcctgtttcactaatccatagactatgtctttgtccctgttttccagccccactgggacttgctttcacctcttcctatatctgtgcttatccaagagacaggagcaaattcaaagacagcataatatcaggctggtggtacacattctgtaggacctagggcctacccttccttccggatcccttgatttccttaaactgatacatgtgacctcaagctccttctcccctctggctgatcctgcttaggaaacaccctgggccaagcctcaggagctctactcaatgacatatgtttgcattagcaggctgaatcttcacttggctaagaccaacattcttagaaagattcttggccttaagtattgatcaaagggttagtgggttggcagttctcatcctgccacacaaaaacacatttcagtgatcctcatcatcacagaggtagtcagtgccagaatgtgagtcagaatccaggctttctgacctccagttagaactgtttccttcacccctttgcccagtagtcagtttcctatttcttcctccctcatgttttattggtacatgttaacattgggaaagaagttctttccctggaagggcaataagagcatctcggaggcagcaagttttgggtgggaagctgaagacgaggatcaaaggcttggctttttgccaggccctcatgatggaacctcatctcttccatgtcttctgcaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggaggtaagaagaggctgctagcaaaaggggagaatgttagggtcctggggtaaaagttccaagttatactggccatctttgcctaataattaggacggttcatgtgaaaagtgtcaagatagcatgaactggccccaaaatatacccagaatctgtcttctgccaggttctctagaaagagtctcattctcggccaggcacagtggctcacgcctgtaatcccagcactttgggaggccgaggcgagtggatcacgaggtcaggagttcaagaccaccctggccaagatggtgaaatcccatatctactaaaaataaaaaaattagccaggagtggtggtgggcgcctgtaatcccagctgcttgggaggctgaggcagagaattgcttgaacccaggaggcggaggttgcagtgagccaagatcatgccactgcactccagcctgggcaacagagcgagaatctgtcaaagaaaagaaaagaaaagaaaagaaacagtctcactgtcatgtccctcacacactatactccagacatgctgaaactacttaaaattgcctaaatcaactattctgtcaagagtttgtgcctttgctcctgtcagattaccctctcctagaccctgtactggagaatctcatacttctcatttgacactaagcttggccatcatctcctctgcaaagcctgcttagacctccaaactgtctaattccaattctggctcatttcccctccctcttctggacttctgtagcccatgtacttcctctatcccagcactgttcacaatgtgtcttcagtgtatgccattcccaccagtttagtagctcccctagcacagggaccagactcatctatctctgtgtctctacaatagcctgagatagggctttaggggtacattagatctcagcaattattgttgagctgaacttatgactagaaatgcaccccaaattactctcttacctttgcatagattctccatcttgggcgaagggccactgtcccttcatgctgtcggaactccaggatgggaagagcaagattgtgcagaaggcagccccagaagtccaggaagatgtgaaggctttcaagacaggttggagtcaagttccaccttatgcaacctttactcctaatgcttgaacacactacgtcacagtcctgagctaggctaatacaaaagcagccagtacacatcccatgatgagaagtccagtctttccaggggagccatggtaggcaacagtttaggctgtatgctgaagcacaccatacctgacaaacacatatgtacgggctcctgaaacttttagtcattattctaagatgagccctctagaattttgactcctctttttcaggtggctaaactgatcccaacaggctggggtcccacatttcagcaagaccactctatgagaatatggatttgcatgaaagagaaagagctgggagtaggtacctcctttaaccagggtgcagatccccaggtcaacttaattagtgcagaccacccaagataatcacccttgagatatggccacactgttgacatctttcataggcccctttgggatatcattaaggacaaaaacttcaaaattgaaatttaatgatgtttagaaaagaagagtaaggtacattatcctgcatctactttctaaatgcaggacccagggtggctgctccagttacctgagccaagggaaaatcctagtggagagaagtatgattcaccttatagaaggtttcctaacaatgtaatagtctccattcggggggataaatagaagctcaccttggagaagatttcttctcgctgtagaagctgcccttaccttataaacttgaattttcatgtgttgcattgagcttaaagaggacaacacatgctttctttttcccccattctcttcacggccaatgaatctcacattccgtctcagatctgcctagctccctggtctcagtcagcctaaggaagccattttccggtccccaggagcaggagcagatctctgggaaggtcacacacctgattcagaacaatatgcctggtgagtttgctgaggtggaaaaaaaggggaccggaatagggaaggcattctgaaagggcctctgtcacagtaggggaaacagtacagaagggccttggaaccaaaggaaatttgagtttaaaatttaatgctggcacttgctggatctaggtgttttggcaagtaagacactttccttcagtggcatttaatacctacctcaataggttaccatgagaagaaagtgaaattacatttatggaagtgtttctaatgaggcttcattaaatattaggcttatttccattatttcttctctatgcttccctcaaaaactttcacccttcatacagcaccttttccccattcttatatgtgtttatattcctttccataatgacatttacattattttctaatgtaaaaggaatatgattcatggtaaaatatttttcaacatatacaggaaagtataaggagggaaatttaagtcatgcagagttccaccattaagtttttgttatattttctcccagatatttttctatggctacacacacacacacacacacacacacacacacaccctctgctctcttcaccacacccatgcttttgttagaagtgtgatcttattttacctggagttcgttatgctgttttgttcacttaaaaatatgtcatgggtatagtatggattcaatatcattcagttaatcaagcatctataatttaagttgtttccaattttttgtattctctcagtttagattgtaggttggttttacatacatacaaatgtactcaaagaaaatgtatagtattacttttttcaatttttatttttacctaataatatcttgctatatattttactctgtgcccttttttcactcaacaatatactgtggaaatgcttccactttaacacatatgtatctaccttatttttcaatgcttcaaaatattttgtagtatagatataatagagattatttggctactcctctatttggttgcttccaattttttctattacaaacagtggtgcaacaaacatccttgaatgtatctccttgtgtacacaggcaagtgtttctccaggataaacactcagtggtggaaattcttgggatgtaaggatgtgtacatttttgatattaatacattttgtcaattagccctccaacatggctgtaccagttatcaaggagggtatccatagtctcatacccttaccagcccttgatattatcaaactttaaatctttatcaattgataggtgaaattttgttttcccagttttatttttcctgattaagaatctttttctacatttattgaattgtctgttcatattctatgcccatttttctactgagttgaaatttttcatgttaatttttcagagattatataataaattctgagtatcaatcatttgtctgttaagtatgctgcaaatatttctctagatatgtcagtatgtgcatttaaaaaacttttgatatgtatttccaaacatctctgcagcaaggatgttaccagtttgcacctccagcagccatataaattgctgtctgcaacatgatttctgtctcacgtaaagagttctagagtttaacaagctctttggcaaacgttatttcaatttatcctagaaataaagttaccccattttgtagtggtaatggttaaagaagtgggctctgagttacttacttgatgaacacttacttgctgcatgaccctggtcaagttgtctaacacttaatgccccagttccctcatctgtaaaatggagatactaatagaactgtccatggagcattgttgtgaggaataaattaaatatttataaagttcctaggaaagaacttacatgtactaggcattcattaaatgttagctataatgatgtaattgaatattagctatctttattagtattattatgactactaatactatagcagtaataatactactattaccatgtgccatttattagtttgaatatattacatgttgttggttgtcagatgctcacaactctccaaggaaagtattattagcctcattctacaaataaagaaatttaaagtaagaaagaagattcatgacttgttcaaggccacacagctaggaagtggcaaagagatcgctagaaacaagatctgttgatactccttccagtgagactgaaagcagtgattctagtaaggaggctgccacaccaacccgggaagagagatgaggccataagaaagtctaaatgaatgtgtgaatgaactactgagtgaatgagtgaatgagtaagcaaaaggatggctgaatgaagtagtagagagttaatgtggtccataagtcaatgactgagcaaataaatgaatatgtggaaaaagagttggagaactcaaaatcagcaacatgggtaaaatacagactagccagggagagacttaaaacgaattcttttcatcctcatatctgctcctgcaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacagtgagtagtaggctttcagccatcagcagtggccagaggagatgaaaaaccacacatggaaaaaaaaaaaaggcagagctggcagtggaaacttgggttctatcaccacttcttttgtccaaggtcctccatcatatctattccttggatatgaaataagtcaacacaccatgtttcccaaactcttcggtgtccaatgctatggaggggaaggatgggagaccaagcaaggcccactctgcctgagtttttaatctagctgcagaattagtattgccagagatggagtgtgacttcctctaggtcttccaaactactcaagctcaacctagcttctccctctctccctgagtacctccagtcctagaaggaaggcacatgtctccctatcctccccatccttccctctactttgtctcataggacacagtttatataggatcactaactcaacattgactcccatcaaggaagagaaacctacccagttcctcgatgcctgacaagagtttctttttctccttttctcctgttttctcctggccagggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccaggtaagcctgaggcctgagctttgttcagggctggtatcctgcaatacagcatccagtttcactggttccatcactccttccctgtatttggagttccctcactcccattgttcttccttcttatccaccttgcatatcctcaacactggataattatatccctctgctttctctccttctgcacgtagagaggaccattaccggggaacattaccccacctcacagaaaggaaacactataaattcatcacctcccaactcaactgagctcttaacacacatacatagttattttatgtctccacaggagctttttcaaacttcttctcctcttctaaaacctctgactaccttctcctccacacttagcaaataacctcacatcttacttcacaataaaaacagaagccccagacagagaatccttatttattgccaccaaacctacgaacttatctaattgtttatctagccttgcctcattctttccttttacaatggaaggcatatctctccttctgcctaaaaccaatcccttcacttgtacactggttcccatattcccagtctcctactctctagtctgtaatgtcctcacctcatacgccttgttgtccttccgccaaggcccaatccagaatgaatacaaccctccatcttcactatatcaattccgggctcatacagttgctcagacaggagtcactaaaaattcatactcttaacctctactgggttctccatggtctctgacaatcccatttccctggtcagttctcgaagtttatggggcagttttgccaaaccaccattatcctcagccttcccacaccccctcctccccatctccctcagcagacaacttcatgttctactacattcaaaatagaagataccagacagcaatgtccttgactcccagccacaaagcacctacaaactcataagcatcttcaaatgtcctctcctcactccttctcttctgtcatagtggaagaagtatcctttttcttgtgactaatccttccactgttgctctgtgccccattcccctctaccaccttaggaatcttgacctattggctctctcctcctctcctgtatcttcagcctctccctctctttaaacatgttttcaagtctcttgtatcttataaaaaaacattgcctcaacccctgatcactctctagctactgccctctttcctccctataacaggcaaactgcttgagagaagtcttcgctcttactatctacttcctcacctcctgctgattcttcagcacagcaaaaatattaccaccacttctcagaaactttttttgagtccacccataagccccaactaaactcaacatctttaagttgtttttagtccatcccctcctcaaccattaaacttctttccatctctactgccagcatcctagcctgatccaacatcattttttaaagaaaattttacctttgccctccgataatctattctttacaacagtcagaattttttttaatgcaaaactatctttgtcaccccaccctcagccctggtcaaaaccctttagtggacccccattcccccaggaccaaatccaaatttcttatcacagcttctaaagttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggaagttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagcagatgctacctggaatggatggaatttcatctagactaggaacaatctagcatcagtccgagtcaacaaacattccctggggtaatccctttttcaagtcttgatcttatatattggggagaaggaaaataggtcccgtcctcaaaaaactctgaagcttcttgggaaattaaatgttcttccaccccaaggcagtcagaggctagaccagggttacaaatgactggagggaaggatgtaggggtcagaatttgggaacagtgaagtccttccaagggagaaagaagtgtcacaaaagttcccagagaaggaagaagcagagcaaggtcttcaaagggaagaaagggttggcccttttctttgccaggtcaaacctgaaggttgaagtgggagtactgggacagaagcttaaggattatacatctgcttcctcagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtatgtatatgagtgagtgtatgtttactagtgttggtctcacaaaaaccatgatgatcatgatgatgatgatgacgataacattataacagctaatatttatagtgtttattatgtgccaagcaaaattattagtattttacatgtattaattcatttaattttctgaacaattctatgtgataggtgttattattattttgattttttacatgaggaaactgagacataagagtaatttgtccaaggtcacacagctagtaaatgccaaagaatggaggcagctattacattcatcttataggtaaagaaactaaagttcagagttggcatccaattcatcttgagtggctcagcaagttggtgctaaagtgagtatctgcaccctaacacatataactccaattcctcgagtaacacttctcttgttagaaatgatatgtaaatcaataatcccagtgtttggtttttatgaaggaaatttcaaaaaccattgcctaggatttttttcaaggtccagtatgaagcattggggtcaaaacaggttttcaagtcagagagacctgggttcaaatcccacctttgacagttactggctatgaccatgggtaactctttaactgtctaagcctcaattttcccaaaggtaaaatatctggttgtaagaattagagatgatagaaaccattctagttattatgctttagtagaattaaatgatcttcacactcctacctcctttctttgctcaattgaaacaatgtccaaagctttctattgctggccctgttgtgtagaaatcatgtgttttaggcatcctcttatggatttatttaagggaagaggtcctcaactcatttcagtttgtcccttttccaactgaaacaaaagagtccatagtattccctgatttaggtatcttaagtggcatgtaatgactatacacacaggctctaaaaccagactatccatgttcaaatcctagcatgaccatttactagcttgggcaagcttcttaattgctctgtgtctcagttctcagttgcttatttgaaaaatgtaagtgataataattaaataggtatgcaaattaaatgagttaatatatgtaagaaacttactattatgcccactcccacatttctaacactagcaataaagtaaaactatcctatcccttttgtatatttctaccactgagactattcaaattcattatttctctagtggaaactatgttggtaccattctacctcgttacatttgcaaataaatagttatttacctatttttggggtgcaaactctgcccaaactgttgatccttaggctgaatctctcccattgaaatgatgctaggctgaacacagcagaaacaggaaaatagacattgtcagaatgaagtaaaaacagaaagacaaagagtcaagccttgatcccaggctggggaacacacacacatgcgcacacacacgtacacacacacacacacacacacacacacacacacacacacacacacacacagagagacagagagagagagagagaaggcagggatgagatacaggcaatcgatccatacacagaggtttgtaatagttctaaatgaaggcgcacatcctccttcctctctacaacacccttttccaacccaaagtaggcatgtatgggaaattccacattggagatggagctggggaagggttatgatgtcctacctctatcccttggctttgctcaggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggtaagtgaatgctttgggccttcttatataccctccagagaggaggcccttacaaaattcttttctgcctcctccccaaagctataggggttgtttggacagaattcacagccccaggctgctgccatcctggactccctctctccactcgcatcccactgcagagttgatgagaaagtctggtagagttttttgaaaagaccttgaactaggccaaatagttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccaggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaaaaagaaaagaaacagaaaatgttggagtacatcacatactaagggtatcatcaatttgtgaaaaatttgtatgcattttgggtatttgcatatacacatgtatgtgtatgtgtgcgtttatggtcacggtgtaaaacgtacttcttattgagaaatgagggcagaaaaataaaatcaaaagccataggattagctgctactttggatcctcaatatgagcatttactgcctttaaaaatgaactgctacttctttcttaaataacacgtatttgtgtgagtcagtaagccagggcagggaaaggacacttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatggaaaaaaaaaatctatcccaaaattcagtgatgttccctcatctagttccctccatctgcttaatggagctagtgatggtggagccagagtggcaggtactgattagcctttctcctgagtccaggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtaagttctcaacatgggtgcctacaggacctccctcccctcagccccaggatctgaaagagaagctgagaggacagagaccactgagtttacaaaatatttctggaacatctaatgtgtgccagcacctatactagggtcacaaataaatgagaagcagcccctacacttgtagggctccagtttggttggggataccatagtgaacacaaacaatgacactaagggatgatcaaagctccacaaggcagtgcatgatagagttgtcggagcagagaggaggggcctgactcagcctgagggatgcaagacccacttcctagtagaggtgacacctgagctgagtcttgcaaagtgagtggtattaaaagaaagagggcatggaagaagtattcctaccagagggaagagcatgaagataggtgaggagaatgagaagcagccagggatatatcaagaacaataagcaggtggtattggaatgtagggtcataggaatggagtggggcaggggagtatcaatctatgagtctacaaagacaacatgagatagagactggattgagaggcttgtagagctgagtagtttgagatttaccctgaaaatgccagtttagtcaattcacctaatgtttgttggatttctgttgggtagttttgtttttgtttgtttgtttttgtttttgtttttttgagacagagtctggctctgtagcccaggctggagtgcagtggcacgatcttggctcactgctacctctgcctcccgggtcctggctcaagcaattctcctgcctcagcctcccaagtagctgggattacaggcacgtgccaccatgcctagctaatttctgtatttttagtagagatggggtttcaccatgttggccaggctagtctcgaactcctgacctcgtaatccacctgcctaggcctcccaaagtgctgggattacaggcgtgagccaccatgcccggcctgggtagtttttaatgcagggcctgacattgaataggtgctcattccaggcctgttggatgaaagacatgtaggcagttgatggtctagcagaggagccagatatagatggtactggtccagtatgatgagctccagtattctgggagctagagggagtggacacattatggagagagagggtgggaaggatgaaattggagaggctttgtgagtaaggaagtttttatgatgcatgttgaagtacatgtgaatatgttgtaagaatattccagaataagggaattccacgagcaatgacctagagataggaaagcagtgggtatgtattgacaacataattctgtttgtctgaagcatgggcagtatgagaattcaaggaagacaagctaggtaggcgccattcattcattcaaaaacattaaataatgctggctaacattaagtacttaccatgtgccaagcactgttctaaacactttacacgtattaactcatctaatccccacaacaacctcaagagttagagatcctcttatcatttccattttgtacatgtggaaattgaggcacaaaaatatatagtcgctgatccaaggtcacacagcttctaagttgcaactgggaggtctgtctctacctccatggtcataactgctaggtctaccacctctctgagctgatgacccagactcctgggccttttgttcagtattctcttttgctctgggcttcaattgtagagctctcagtattcttggttctctgaatgtccacctaggctaggcttttgtaagaatatatgaggcatccacgatggctccaccagtccctaagttccatagccaatccatcctgaaatcctgcaaaagttatctataatctctctcaaacctatttgcttttctcccctgccacttctttaatccatgtcaacatgatttttttcctaatttctctgcttctctcttgctcctctcaaatcctttctcgatgatgaccactagagggatttttctaaaattctgactatattgctcccttgcttaaaccccttcatgtttccctctagactctaaagcagtgacctccaaggggtatgcaaaatgattacagggtgaaggaacagaatatgtattagaattttatgtttttttatcttaaaaataggaaatcaagcatcactgatactgatctttaatatacagactgacagttatacatgtatataatatataaacaaatatagagattggaggtacatgctaaaacatttgtactgatagggatgtatagtccaaaatttggaaacattgacatataggacagagttgaagctcttcagcatagcattcaatgccttccacatggtgatctctatgccctcacctcctccccacatgcattttgttttttcagctacactgaaggacttgtcgttccctcatttttttctgctctcttacctctgggactttgctcatgctgctctcttttgattggaatgccctccctcacactttcctctggcttactttccttcatcttgtagacttaacttaggcattctttcaacaaatatttattgagtaccaactgtgtactagatactgttctaggcactggggatgcagtagcaaacaaatcagacacaaaattcctaccctctggagcttacattctagtggaaggggtagtaaaaaaaattaccaaaaataagcaaattaagtagcacattagttctaagtgctatgggaaaaaataaagcaggataaggagaatgggataaggggccaggggcgagttcagagaagggttgtagtattagagtggcaagggtagaagacgctgaggtgaaacttgagcaaaaatttgaaggaggtgaagttagtgaggcagatatctaagggaatggcatcgcaggcagagggaacatcctaaggcagggaagacacaggagtattccttttatatttgaggaacagtaagaagatgggtgtgggtggaatggtataagcaagtgggagacagaaaaattgagtacatagaggcaatgtgggaccagattgtatagggtatggtaggccattagaaggagtttggcttttactctgagagcccttgaaaggatttgaacacaggactgatatttctgactcgggttttaacaaaattgctccaacttctatgtagagaatacactaaaagggagcaagggtggaagcagggagacccaagagtgggctacagtaatatcccaggtgagagatgatggtggctcagacttgatcataatgaaggcaataagaagtggtcagattttgaaggtagagccaagggtctttgctgatagatgggatatagggtaagagagaaagagaaaaataaaggatagctctgaaatttttggactgagcaactggaattgccatccactgagatgggaaaagctaaaagtagaatagcttggtggagggtagggacatgagtagctcagttgtactcctaagttagaaatgcatattagacatctaggtggagatggagaaaagccattggatatacaagattggaaaccagtagagtggcgtgagctggagattaaaatttctgaaccatcagcatatagatggtctttaaagtcatgtgactagacaagatcaacaagggcatgaacacagaaaaggccaagaacagagccctggaacgtacctggggtacttcctccagctaggtcaggttcccttctctgggttttcacacccccaggtggaccccctaccccaggtttcctggtcatagcaccaatgacacagtatagttactgtcattatcattgtcctcatagggcttagagttcccaagcagacagtcattcttgggccacagcacatcctatacttagggagtggtccaggccaggacagtatggcttcaaattgtgtcaaaggagagcttccaaatcttttataatatatatcccagcatccagatacaaatggtaatattcacggcacacacagaagcaaacagtaggctacttctggccctgaggtatcttgaagggttgagggggatcaatatcttggctcatctgtactgtgacagatttggaagatctagtctaacccattttttccctcccctccccctaccaccttcagagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagct

SEQ ID NO: 3426 - DNA, 21922 bp, human
acctgtcattcgttcgtcctcagtgcagggcaacaggtaagagctgctttcagcctggcaccctatctctggtctgccagctggtctctcagggctgtacacactgactctctggtctgagtagatctgactttttcctttgtttgtttcttagaatctgtctctttttcattttctttttatctcccatgtctctttctgtctttcctcattttcagcttttttctctctttttcccttcgttactttcttttgttagttttcaagatcattcatttcatttcatcattctctgacactcttgctttctcttatttttccctctgaattctaactatctttttctctaaatttctttctctccccctttttgtctctttcctcggctttgtatctctccgtctctgtgtttctgtctctctcttcctctctatcaagaacgatggcttaatatttcttcctgcaattccccattcctctctccctttgactccctctacctgctgggctgacagcagagctcagtgggtcagagcccatggggagcctaggggtgggggaagagctagggagggaaactaagaggatgtgggggtgatgggaatgatgaattgggtaaggagagatttggggaattgagagatgaataattagcagaaataagtgaagaaagtggaagaggaatgtagtgtcactatacagaaagtaaacagatttctattctcatcctaattcactgtgagaccctaggcaagtcattcactctctgaaaaaaaggcttggcctgtaatttccaccaccctttctagttttgattttgtgatcttctaaattttcctgtttctaagaatttctgattctctgattacagttatctaaagttctgtatgattctttcatggtgggaaaggggtactaggaagagaagtaaggcctgatgtttccaactcctgaagagaaattaccacttcccttccagacctaattgacttttgcaaagcaggccacaaaaggggtgggggggtgggggacaaggaatgctgcaatgagtgttttctggctgtctgctggggtagagttgcagttggcccttttcacctctgggagtacagattgggtgctgacacaagagaggattttaaagtcgtagggaaaaactttcagtaatgatctgttacttggtctcaaatttcaccatcatctctttggttaaaagtattgttttaagaagatgcctggcaagcattatcacacattaggtacataagttattgaatggtagagtaaatgaatattcaacagtacctgaaattccactgtagttacagatctgttcctttggtaaggcattggtgacaaatggcatatgacctggaaagaggcctatgttagtgcagcagaggagataaatgtctagagtcaggccctcagtcaagaaaaaaaggtagtaatatttgaatcacagatccataatggttaagttaggaatctctggaaacagattgcctaggttcaaatcctgcttctcctatgtactagctttctgatctagacaggttacttaatctttttgggattcagtttccctatcatcacagggttgacatgagaacacggcctggcacagagggctctgtaagtgtttgactatcagaactaggcggaatctatgaaattatctagtccaatgtcagtggagaaacggaagcccagagaggggaattacagagcccaagttcacacaataaattgtaacaggattgggacaagaatcaattctctagcttcccaaacccagcctggtatattcatgtgacttcccttggctgtacgttcattttttctacatgggaaatggagaaaataaaaataataaagtctatcaattaaatataatatttaacacttttttactgtttactctgggataggtactctgctaaatgctttatatggattatcttactgaatcttcacaacattcctgtgatgcagattgtccttgttattaccaacattttccagatataagatgtacagcagggaagtgacttttctaaggtcccaaagctagtgagtggtggagccaggattcaaacccaagtagtttggctctagagcctatactctttataccctaaattgactaaaatgcttccttgattcaattttactcactctagtctcttggtaggtaatgagatggaatagaaacagagcccatggtaactagactacaaggtcatgggtataatgatggccaggcagagtgaggcagagcaaatttcaggaaaggagtaacagaacaagagaaatgagaacaggagcttgaaagaacttgagaattcaacaaattccaagaagtggtctatattttcccaggaccctgagcatatcatggccaaaagccccctagtaatgatgtgtgttaatttctcctgtttttatatacaggaggtaggtcttctccaccatcccaaggcaggactggactttgcctccaatattgggggctttccttcccactacataccccaatgttgttggcattattgttgccagtattgatgttaggggagtttacaggagcctggagccttgtcatctgccttgcctgcacttctgggccatccatttcttaccaccaatagccagggccagctctagccagatgctcagacgtgattccaggaaggggctcctcttctctcccacgccctggtctcagcttggggagtggtcagaccccaatggcgataaactctggcaactttatctgtggtctgcaggctcagccccaagtgctttagctttcacaagcaggcaggggaagggaaacacatatctccagatatgaggtaggcactggatccaattccttacctaccttgtgaagtggccataattacctcacgtttgacagctgatgaaggccaagatccagagaggggaagtgatttgaacaagaacatccaacaatgaaattggagagctggaattttaataagaaaagctaacatttattgaagatttactatgtgccaaaaactatactaaaggcttaacttggattgtttcatttagtccctccaacaacccttctgtcttttccaatttcagggcccacatgccttggccccacataccaacccaggctgctgtgacagcccatgagagggggagaggttgctctgggatggaacaagaaaaagaggttgttttgtgaggtacggggagggtgcttgttctatgagatcaggaagggagggagatgaaggaggttgccatatgagggcagggccatgagctgacctgtccctcaaaacataaggctgagggtgctagtagattctactcagtaactttcttcacagtgtcagtgctttagtcttctcacattctcccatgtctctcccattgtactgtcccttatcttgtctcactttttgactctgtctttccaatttgccctttttctttacatctgtctctccttcttgctctctctagctgtctttctcttggtgtctctcagctctcacccctcttaaccctcatccccctgctttagtcacctctctgtctctatcctttgatcttgtcattttctctactctcttctctctgtccctcagtctctctctcatctccctcaattagggccatgattctcttccctaaacttacttagccttttgcaatttctggcagcatttttttatgtttgtgtctgactgactctctacccctgctggatcctctccactcctgttctcacttctatgaatctttgtataatcctctagactcattgatccctcctcatgtccctttcgtgccccttggtctatctgtctctgcctttatccctgtgtgcactatcaccaccccctttttcttttttcattttctctttctctcgactcaatctctgttttcatctctaccctgctccctttccctctacctttgatctctttttccccctcaatttctgttcttttaactctaccaccaccaccacatctttgttctctctctactttcctccttttatctttcctaaattttcttttcttctggcttttctcctagtcccttctccttcctcaatttcagactctgttcattcatcaatttaccccaaaattcaacaaatatttattgagtgcctgtgtgtcatttgctttctctttttctgatctctttgccccctttctcttctctgtcttggcctctgcctgtttcactaatccatagactatgtctttgtccctgttttccagccccactgggacttgctttcacctcttcctatatctgtgcttatccaagagacaggagcaaattcaaagacagcataatatcaggctggtggtacacattctgtaggacctagggcctacccttccttccggatcccttgatttccttaaactgatacatgtgacctcaagctccttctcccctctggctgatcctgcttaggaaacaccctgggccaagcctcaggagctctactcaatgacatatgtttgcattagcaggctgaatcttcacttggctaagaccaacattcttagaaagattcttggccttaagtattgatcaaagggttagtgggttggcagttctcatcctgccacacaaaaacacatttcagtgatcctcatcatcacagaggtagtcagtgccagaatgtgagtcagaatccaggctttctgacctccagttagaactgtttccttcacccctttgcccagtagtcagtttcctatttcttcctccctcatgttttattggtacatgttaacattgggaaagaagttctttccctggaagggcaataagagcatctcggaggcagcaagttttgggtgggaagctgaagacgaggatcaaaggcttggctttttgccaggccctcatgatggaacctcatctcttccatgtcttctgcaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggaggtaagaagaggctgctagcaaaaggggagaatgttagggtcctggggtaaaagttccaagttatactggccatctttgcctaataattaggacggttcatgtgaaaagtgtcaagatagcatgaactggccccaaaatatacccagaatctgtcttctgccaggttctctagaaagagtctcattctcggccaggcacagtggctcacgcctgtaatcccagcactttgggaggccgaggcgagtggatcacgaggtcaggagttcaagaccaccctggccaagatggtgaaatcccatatctactaaaaataaaaaaattagccaggagtggtggtgggcgcctgtaatcccagctgcttgggaggctgaggcagagaattgcttgaacccaggaggcggaggttgcagtgagccaagatcatgccactgcactccagcctgggcaacagagcgagaatctgtcaaagaaaagaaaagaaaagaaaagaaacagtctcactgtcatgtccctcacacactatactccagacatgctgaaactacttaaaattgcctaaatcaactattctgtcaagagtttgtgcctttgctcctgtcagattaccctctcctagaccctgtactggagaatctcatacttctcatttgacactaagcttggccatcatctcctctgcaaagcctgcttagacctccaaactgtctaattccaattctggctcatttcccctccctcttctggacttctgtagcccatgtacttcctctatcccagcactgttcacaatgtgtcttcagtgtatgccattcccaccagtttagtagctcccctagcacagggaccagactcatctatctctgtgtctctacaatagcctgagatagggctttaggggtacattagatctcagcaattattgttgagctgaacttatgactagaaatgcaccccaaattactctcttacctttgcatagattctccatcttgggcgaagggccactgtcccttcatgctgtcggaactccaggatgggaagagcaagattgtgcagaaggcagccccagaagtccaggaagatgtgaaggctttcaagacaggttggagtcaagttccaccttatgcaacctttactcctaatgcttgaacacactacgtcacagtcctgagctaggctaatacaaaagcagccagtacacatcccatgatgagaagtccagtctttccaggggagccatggtaggcaacagtttaggctgtatgctgaagcacaccatacctgacaaacacatatgtacgggctcctgaaacttttagtcattattctaagatgagccctctagaattttgactcctctttttcaggtggctaaactgatcccaacaggctggggtcccacatttcagcaagaccactctatgagaatatggatttgcatgaaagagaaagagctgggagtaggtacctcctttaaccagggtgcagatccccaggtcaacttaattagtgcagaccacccaagataatcacccttgagatatggccacactgttgacatctttcataggcccctttgggatatcattaaggacaaaaacttcaaaattgaaatttaatgatgtttagaaaagaagagtaaggtacattatcctgcatctactttctaaatgcaggacccagggtggctgctccagttacctgagccaagggaaaatcctagtggagagaagtatgattcaccttatagaaggtttcctaacaatgtaatagtctccattcggggggataaatagaagctcaccttggagaagatttcttctcgctgtagaagctgcccttaccttataaacttgaattttcatgtgttgcattgagcttaaagaggacaacacatgctttctttttcccccattctcttcacggccaatgaatctcacattccgtctcagatctgcctagctccctggtctcagtcagcctaaggaagccattttccggtccccaggagcaggagcagatctctgggaaggtcacacacctgattcagaacaatatgcctggtgagtttgctgaggtggaaaaaaaggggaccggaatagggaaggcattctgaaagggcctctgtcacagtaggggaaacagtacagaagggccttggaaccaaaggaaatttgagtttaaaatttaatgctggcacttgctggatctaggtgttttggcaagtaagacactttccttcagtggcatttaatacctacctcaataggttaccatgagaagaaagtgaaattacatttatggaagtgtttctaatgaggcttcattaaatattaggcttatttccattatttcttctctatgcttccctcaaaaactttcacccttcatacagcaccttttccccattcttatatgtgtttatattcctttccataatgacatttacattattttctaatgtaaaaggaatatgattcatggtaaaatatttttcaacatatacaggaaagtataaggagggaaatttaagtcatgcagagttccaccattaagtttttgttatattttctcccagatatttttctatggctacacacacacacacacacacacacacacacacaccctctgctctcttcaccacacccatgcttttgttagaagtgtgatcttattttacctggagttcgttatgctgttttgttcacttaaaaatatgtcatgggtatagtatggattcaatatcattcagttaatcaagcatctataatttaagttgtttccaattttttgtattctctcagtttagattgtaggttggttttacatacatacaaatgtactcaaagaaaatgtatagtattacttttttcaatttttatttttacctaataatatcttgctatatattttactctgtgcccttttttcactcaacaatatactgtggaaatgcttccactttaacacatatgtatctaccttatttttcaatgcttcaaaatattttgtagtatagatataatagagattatttggctactcctctatttggttgcttccaattttttctattacaaacagtggtgcaacaaacatccttgaatgtatctccttgtgtacacaggcaagtgtttctccaggataaacactcagtggtggaaattcttgggatgtaaggatgtgtacatttttgatattaatacattttgtcaattagccctccaacatggctgtaccagttatcaaggagggtatccatagtctcatacccttaccagcccttgatattatcaaactttaaatctttatcaattgataggtgaaattttgttttcccagttttatttttcctgattaagaatctttttctacatttattgaattgtctgttcatattctatgcccatttttctactgagttgaaatttttcatgttaatttttcagagattatataataaattctgagtatcaatcatttgtctgttaagtatgctgcaaatatttctctagatatgtcagtatgtgcatttaaaaaacttttgatatgtatttccaaacatctctgcagcaaggatgttaccagtttgcacctccagcagccatataaattgctgtctgcaacatgatttctgtctcacgtaaagagttctagagtttaacaagctctttggcaaacgttatttcaatttatcctagaaataaagttaccccattttgtagtggtaatggttaaagaagtgggctctgagttacttacttgatgaacacttacttgctgcatgaccctggtcaagttgtctaacacttaatgccccagttccctcatctgtaaaatggagatactaatagaactgtccatggagcattgttgtgaggaataaattaaatatttataaagttcctaggaaagaacttacatgtactaggcattcattaaatgttagctataatgatgtaattgaatattagctatctttattagtattattatgactactaatactatagcagtaataatactactattaccatgtgccatttattagtttgaatatattacatgttgttggttgtcagatgctcacaactctccaaggaaagtattattagcctcattctacaaataaagaaatttaaagtaagaaagaagattcatgacttgttcaaggccacacagctaggaagtggcaaagagatcgctagaaacaagatctgttgatactccttccagtgagactgaaagcagtgattctagtaaggaggctgccacaccaacccgggaagagagatgaggccataagaaagtctaaatgaatgtgtgaatgaactactgagtgaatgagtgaatgagtaagcaaaaggatggctgaatgaagtagtagagagttaatgtggtccataagtcaatgactgagcaaataaatgaatatgtggaaaaagagttggagaactcaaaatcagcaacatgggtaaaatacagactagccagggagagacttaaaacgaattcttttcatcctcatatctgctcctgcaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacagtgagtagtaggctttcagccatcagcagtggccagaggagatgaaaaaccacacatggaaaaaaaaaaaaggcagagctggcagtggaaacttgggttctatcaccacttcttttgtccaaggtcctccatcatatctattccttggatatgaaataagtcaacacaccatgtttcccaaactcttcggtgtccaatgctatggaggggaaggatgggagaccaagcaaggcccactctgcctgagtttttaatctagctgcagaattagtattgccagagatggagtgtgacttcctctaggtcttccaaactactcaagctcaacctagcttctccctctctccctgagtacctccagtcctagaaggaaggcacatgtctccctatcctccccatccttccctctactttgtctcataggacacagtttatataggatcactaactcaacattgactcccatcaaggaagagaaacctacccagttcctcgatgcctgacaagagtttctttttctccttttctcctgttttctcctggccagggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccaggtaagcctgaggcctgagctttgttcagggctggtatcctgcaatacagcatccagtttcactggttccatcactccttccctgtatttggagttccctcactcccattgttcttccttcttatccaccttgcatatcctcaacactggataattatatccctctgctttctctccttctgcacgtagagaggaccattaccggggaacattaccccacctcacagaaaggaaacactataaattcatcacctcccaactcaactgagctcttaacacacatacatagttattttatgtctccacaggagctttttcaaacttcttctcctcttctaaaacctctgactaccttctcctccacacttagcaaataacctcacatcttacttcacaataaaaacagaagccccagacagagaatccttatttattgccaccaaacctacgaacttatctaattgtttatctagccttgcctcattctttccttttacaatggaaggcatatctctccttctgcctaaaaccaatcccttcacttgtacactggttcccatattcccagtctcctactctctagtctgtaatgtcctcacctcatacgccttgttgtccttccgccaaggcccaatccagaatgaatacaaccctccatcttcactatatcaattccgggctcatacagttgctcagacaggagtcactaaaaattcatactcttaacctctactgggttctccatggtctctgacaatcccatttccctggtcagttctcgaagtttatggggcagttttgccaaaccaccattatcctcagccttcccacaccccctcctccccatctccctcagcagacaacttcatgttctactacattcaaaatagaagataccagacagcaatgtccttgactcccagccacaaagcacctacaaactcataagcatcttcaaatgtcctctcctcactccttctcttctgtcatagtggaagaagtatcctttttcttgtgactaatccttccactgttgctctgtgccccattcccctctaccaccttaggaatcttgacctattggctctctcctcctctcctgtatcttcagcctctccctctctttaaacatgttttcaagtctcttgtatcttataaaaaaacattgcctcaacccctgatcactctctagctactgccctctttcctccctataacaggcaaactgcttgagagaagtcttcgctcttactatctacttcctcacctcctgctgattcttcagcacagcaaaaatattaccaccacttctcagaaactttttttgagtccacccataagccccaactaaactcaacatctttaagttgtttttagtccatcccctcctcaaccattaaacttctttccatctctactgccagcatcctagcctgatccaacatcattttttaaagaaaattttacctttgccctccgataatctattctttacaacagtcagaattttttttaatgcaaaactatctttgtcaccccaccctcagccctggtcaaaaccctttagtggacccccattcccccaggaccaaatccaaatttcttatcacagcttctaaagttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggaagttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagcagatgctacctggaatggatggaatttcatctagactaggaacaatctagcatcagtccgagtcaacaaacattccctggggtaatccctttttcaagtcttgatcttatatattggggagaaggaaaataggtcccgtcctcaaaaaactctgaagcttcttgggaaattaaatgttcttccaccccaaggcagtcagaggctagaccagggttacaaatgactggagggaaggatgtaggggtcagaatttgggaacagtgaagtccttccaagggagaaagaagtgtcacaaaagttcccagagaaggaagaagcagagcaaggtcttcaaagggaagaaagggttggcccttttctttgccaggtcaaacctgaaggttgaagtgggagtactgggacagaagcttaaggattatacatctgcttcctcagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtatgtatatgagtgagtgtatgtttactagtgttggtctcacaaaaaccatgatgatcatgatgatgatgatgacgataacattataacagctaatatttatagtgtttattatgtgccaagcaaaattattagtattttacatgtattaattcatttaattttctgaacaattctatgtgataggtgttattattattttgattttttacatgaggaaactgagacataagagtaatttgtccaaggtcacacagctagtaaatgccaaagaatggaggcagctattacattcatcttataggtaaagaaactaaagttcagagttggcatccaattcatcttgagtggctcagcaagttggtgctaaagtgagtatctgcaccctaacacatataactccaattcctcgagtaacacttctcttgttagaaatgatatgtaaatcaataatcccagtgtttggtttttatgaaggaaatttcaaaaaccattgcctaggatttttttcaaggtccagtatgaagcattggggtcaaaacaggttttcaagtcagagagacctgggttcaaatcccacctttgacagttactggctatgaccatgggtaactctttaactgtctaagcctcaattttcccaaaggtaaaatatctggttgtaagaattagagatgatagaaaccattctagttattatgctttagtagaattaaatgatcttcacactcctacctcctttctttgctcaattgaaacaatgtccaaagctttctattgctggccctgttgtgtagaaatcatgtgttttaggcatcctcttatggatttatttaagggaagaggtcctcaactcatttcagtttgtcccttttccaactgaaacaaaagagtccatagtattccctgatttaggtatcttaagtggcatgtaatgactatacacacaggctctaaaaccagactatccatgttcaaatcctagcatgaccatttactagcttgggcaagcttcttaattgctctgtgtctcagttctcagttgcttatttgaaaaatgtaagtgataataattaaataggtatgcaaattaaatgagttaatatatgtaagaaacttactattatgcccactcccacatttctaacactagcaataaagtaaaactatcctatcccttttgtatatttctaccactgagactattcaaattcattatttctctagtggaaactatgttggtaccattctacctcgttacatttgcaaataaatagttatttacctatttttggggtgcaaactctgcccaaactgttgatccttaggctgaatctctcccattgaaatgatgctaggctgaacacagcagaaacaggaaaatagacattgtcagaatgaagtaaaaacagaaagacaaagagtcaagccttgatcccaggctggggaacacacacacatgcgcacacacacgtacacacacacacacacacacacacacacacacacacacacacacacacacagagagacagagagagagagagagaaggcagggatgagatacaggcaatcgatccatacacagaggtttgtaatagttctaaatgaaggcgcacatcctccttcctctctacaacacccttttccaacccaaagtaggcatgtatgggaaattccacattggagatggagctggggaagggttatgatgtcctacctctatcccttggctttgctcaggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggtaagtgaatgctttgggccttcttatataccctccagagaggaggcccttacaaaattcttttctgcctcctccccaaagctataggggttgtttggacagaattcacagccccaggctgctgccatcctggactccctctctccactcgcatcccactgcagagttgatgagaaagtctggtagagttttttgaaaagaccttgaactaggccaaatagttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccaggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaaaaagaaaagaaacagaaaatgttggagtacatcacatactaagggtatcatcaatttgtgaaaaatttgtatgcattttgggtatttgcatatacacatgtatgtgtatgtgtgcgtttatggtcacggtgtaaaacgtacttcttattgagaaatgagggcagaaaaataaaatcaaaagccataggattagctgctactttggatcctcaatatgagcatttactgcctttaaaaatgaactgctacttctttcttaaataacacgtatttgtgtgagtcagtaagccagggcagggaaaggacacttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatggaaaaaaaaaatctatcccaaaattcagtgatgttccctcatctagttccctccatctgcttaatggagctagtgatggtggagccagagtggcaggtactgattagcctttctcctgagtccaggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtaagttctcaacatgggtgcctacaggacctccctcccctcagccccaggatctgaaagagaagctgagaggacagagaccactgagtttacaaaatatttctggaacatctaatgtgtgccagcacctatactagggtcacaaataaatgagaagcagcccctacacttgtagggctccagtttggttggggataccatagtgaacacaaacaatgacactaagggatgatcaaagctccacaaggcagtgcatgatagagttgtcggagcagagaggaggggcctgactcagcctgagggatgcaagacccacttcctagtagaggtgacacctgagctgagtcttgcaaagtgagtggtattaaaagaaagagggcatggaagaagtattcctaccagagggaagagcatgaagataggtgaggagaatgagaagcagccagggatatatcaagaacaataagcaggtggtattggaatgtagggtcataggaatggagtggggcaggggagtatcaatctatgagtctacaaagacaacatgagatagagactggattgagaggcttgtagagctgagtagtttgagatttaccctgaaaatgccagtttagtcaattcacctaatgtttgttggatttctgttgggtagttttgtttttgtttgtttgtttttgtttttgtttttttgagacagagtctggctctgtagcccaggctggagtgcagtggcacgatcttggctcactgctacctctgcctcccgggtcctggctcaagcaattctcctgcctcagcctcccaagtagctgggattacaggcacgtgccaccatgcctagctaatttctgtatttttagtagagatggggtttcaccatgttggccaggctagtctcgaactcctgacctcgtaatccacctgcctaggcctcccaaagtgctgggattacaggcgtgagccaccatgcccggcctgggtagtttttaatgcagggcctgacattgaataggtgctcattccaggcctgttggatgaaagacatgtaggcagttgatggtctagcagaggagccagatatagatggtactggtccagtatgatgagctccagtattctgggagctagagggagtggacacattatggagagagagggtgggaaggatgaaattggagaggctttgtgagtaaggaagtttttatgatgcatgttgaagtacatgtgaatatgttgtaagaatattccagaataagggaattccacgagcaatgacctagagataggaaagcagtgggtatgtattgacaacataattctgtttgtctgaagcatgggcagtatgagaattcaaggaagacaagctaggtaggcgccattcattcattcaaaaacattaaataatgctggctaacattaagtacttaccatgtgccaagcactgttctaaacactttacacgtattaactcatctaatccccacaacaacctcaagagttagagatcctcttatcatttccattttgtacatgtggaaattgaggcacaaaaatatatagtcgctgatccaaggtcacacagcttctaagttgcaactgggaggtctgtctctacctccatggtcataactgctaggtctaccacctctctgagctgatgacccagactcctgggccttttgttcagtattctcttttgctctgggcttcaattgtagagctctcagtattcttggttctctgaatgtccacctaggctaggcttttgtaagaatatatgaggcatccacgatggctccaccagtccctaagttccatagccaatccatcctgaaatcctgcaaaagttatctataatctctctcaaacctatttgcttttctcccctgccacttctttaatccatgtcaacatgatttttttcctaatttctctgcttctctcttgctcctctcaaatcctttctcgatgatgaccactagagggatttttctaaaattctgactatattgctcccttgcttaaaccccttcatgtttccctctagactctaaagcagtgacctccaaggggtatgcaaaatgattacagggtgaaggaacagaatatgtattagaattttatgtttttttatcttaaaaataggaaatcaagcatcactgatactgatctttaatatacagactgacagttatacatgtatataatatataaacaaatatagagattggaggtacatgctaaaacatttgtactgatagggatgtatagtccaaaatttggaaacattgacatataggacagagttgaagctcttcagcatagcattcaatgccttccacatggtgatctctatgccctcacctcctccccacatgcattttgttttttcagctacactgaaggacttgtcgttccctcatttttttctgctctcttacctctgggactttgctcatgctgctctcttttgattggaatgccctccctcacactttcctctggcttactttccttcatcttgtagacttaacttaggcattctttcaacaaatatttattgagtaccaactgtgtactagatactgttctaggcactggggatgcagtagcaaacaaatcagacacaaaattcctaccctctggagcttacattctagtggaaggggtagtaaaaaaaattaccaaaaataagcaaattaagtagcacattagttctaagtgctatgggaaaaaataaagcaggataaggagaatgggataaggggccaggggcgagttcagagaagggttgtagtattagagtggcaagggtagaagacgctgaggtgaaacttgagcaaaaatttgaaggaggtgaagttagtgaggcagatatctaagggaatggcatcgcaggcagagggaacatcctaaggcagggaagacacaggagtattccttttatatttgaggaacagtaagaagatgggtgtgggtggaatggtataagcaagtgggagacagaaaaattgagtacatagaggcaatgtgggaccagattgtatagggtatggtaggccattagaaggagtttggcttttactctgagagcccttgaaaggatttgaacacaggactgatatttctgactcgggttttaacaaaattgctccaacttctatgtagagaatacactaaaagggagcaagggtggaagcagggagacccaagagtgggctacagtaatatcccaggtgagagatgatggtggctcagacttgatcataatgaaggcaataagaagtggtcagattttgaaggtagagccaagggtctttgctgatagatgggatatagggtaagagagaaagagaaaaataaaggatagctctgaaatttttggactgagcaactggaattgccatccactgagatgggaaaagctaaaagtagaatagcttggtggagggtagggacatgagtagctcagttgtactcctaagttagaaatgcatattagacatctaggtggagatggagaaaagccattggatatacaagattggaaaccagtagagtggcgtgagctggagattaaaatttctgaaccatcagcatatagatggtctttaaagtcatgtgactagacaagatcaacaagggcatgaacacagaaaaggccaagaacagagccctggaacgtacctggggtacttcctccagctaggtcaggttcccttctctgggttttcacacccccaggtggaccccctaccccaggtttcctggtcatagcaccaatgacacagtatagttactgtcattatcattgtcctcatagggcttagagttcccaagcagacagtcattcttgggccacagcacatcctatacttagggagtggtccaggccaggacagtatggcttcaaattgtgtcaaaggagagcttccaaatcttttataatatatatcccagcatccagatacaaatggtaatattcacggcacacacagaagcaaacagtaggctacttctggccctgaggtatcttgaagggttgagggggatcaatatcttggctcatctgtactgtgacagatttggaagatctagtctaacccattttttccctcccctccccctaccaccttcagagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagc

SEQ ID NO: 3427 - DNA, 22009 bp, human
aatgcagggccaggccggcagaaggcagggtgggtggggctgagtcagaggagaagggataaatgccaggtcctaacccaagtacccacctgtcattcgttcgtcctcagtgcagggcaacaggtaagagctgctttcagcctggcaccctatctctggtctgccagctggtctctcagggctgtacacactgactctctggtctgagtagatctgactttttcctttgtttgtttcttagaatctgtctctttttcattttctttttatctcccatgtctctttctgtctttcctcattttcagcttttttctctctttttcccttcgttactttcttttgttagttttcaagatcattcatttcatttcatcattctctgacactcttgctttctcttatttttccctctgaattctaactatctttttctctaaatttctttctctccccctttttgtctctttcctcggctttgtatctctccgtctctgtgtttctgtctctctcttcctctctatcaagaacgatggcttaatatttcttcctgcaattccccattcctctctccctttgactccctctacctgctgggctgacagcagagctcagtgggtcagagcccatggggagcctaggggtgggggaagagctagggagggaaactaagaggatgtgggggtgatgggaatgatgaattgggtaaggagagatttggggaattgagagatgaataattagcagaaataagtgaagaaagtggaagaggaatgtagtgtcactatacagaaagtaaacagatttctattctcatcctaattcactgtgagaccctaggcaagtcattcactctctgaaaaaaaggcttggcctgtaatttccaccaccctttctagttttgattttgtgatcttctaaattttcctgtttctaagaatttctgattctctgattacagttatctaaagttctgtatgattctttcatggtgggaaaggggtactaggaagagaagtaaggcctgatgtttccaactcctgaagagaaattaccacttcccttccagacctaattgacttttgcaaagcaggccacaaaaggggtgggggggtgggggacaaggaatgctgcaatgagtgttttctggctgtctgctggggtagagttgcagttggcccttttcacctctgggagtacagattgggtgctgacacaagagaggattttaaagtcgtagggaaaaactttcagtaatgatctgttacttggtctcaaatttcaccatcatctctttggttaaaagtattgttttaagaagatgcctggcaagcattatcacacattaggtacataagttattgaatggtagagtaaatgaatattcaacagtacctgaaattccactgtagttacagatctgttcctttggtaaggcattggtgacaaatggcatatgacctggaaagaggcctatgttagtgcagcagaggagataaatgtctagagtcaggccctcagtcaagaaaaaaaggtagtaatatttgaatcacagatccataatggttaagttaggaatctctggaaacagattgcctaggttcaaatcctgcttctcctatgtactagctttctgatctagacaggttacttaatctttttgggattcagtttccctatcatcacagggttgacatgagaacacggcctggcacagagggctctgtaagtgtttgactatcagaactaggcggaatctatgaaattatctagtccaatgtcagtggagaaacggaagcccagagaggggaattacagagcccaagttcacacaataaattgtaacaggattgggacaagaatcaattctctagcttcccaaacccagcctggtatattcatgtgacttcccttggctgtacgttcattttttctacatgggaaatggagaaaataaaaataataaagtctatcaattaaatataatatttaacacttttttactgtttactctgggataggtactctgctaaatgctttatatggattatcttactgaatcttcacaacattcctgtgatgcagattgtccttgttattaccaacattttccagatataagatgtacagcagggaagtgacttttctaaggtcccaaagctagtgagtggtggagccaggattcaaacccaagtagtttggctctagagcctatactctttataccctaaattgactaaaatgcttccttgattcaattttactcactctagtctcttggtaggtaatgagatggaatagaaacagagcccatggtaactagactacaaggtcatgggtataatgatggccaggcagagtgaggcagagcaaatttcaggaaaggagtaacagaacaagagaaatgagaacaggagcttgaaagaacttgagaattcaacaaattccaagaagtggtctatattttcccaggaccctgagcatatcatggccaaaagccccctagtaatgatgtgtgttaatttctcctgtttttatatacaggaggtaggtcttctccaccatcccaaggcaggactggactttgcctccaatattgggggctttccttcccactacataccccaatgttgttggcattattgttgccagtattgatgttaggggagtttacaggagcctggagccttgtcatctgccttgcctgcacttctgggccatccatttcttaccaccaatagccagggccagctctagccagatgctcagacgtgattccaggaaggggctcctcttctctcccacgccctggtctcagcttggggagtggtcagaccccaatggcgataaactctggcaactttatctgtggtctgcaggctcagccccaagtgctttagctttcacaagcaggcaggggaagggaaacacatatctccagatatgaggtaggcactggatccaattccttacctaccttgtgaagtggccataattacctcacgtttgacagctgatgaaggccaagatccagagaggggaagtgatttgaacaagaacatccaacaatgaaattggagagctggaattttaataagaaaagctaacatttattgaagatttactatgtgccaaaaactatactaaaggcttaacttggattgtttcatttagtccctccaacaacccttctgtcttttccaatttcagggcccacatgccttggccccacataccaacccaggctgctgtgacagcccatgagagggggagaggttgctctgggatggaacaagaaaaagaggttgttttgtgaggtacggggagggtgcttgttctatgagatcaggaagggagggagatgaaggaggttgccatatgagggcagggccatgagctgacctgtccctcaaaacataaggctgagggtgctagtagattctactcagtaactttcttcacagtgtcagtgctttagtcttctcacattctcccatgtctctcccattgtactgtcccttatcttgtctcactttttgactctgtctttccaatttgccctttttctttacatctgtctctccttcttgctctctctagctgtctttctcttggtgtctctcagctctcacccctcttaaccctcatccccctgctttagtcacctctctgtctctatcctttgatcttgtcattttctctactctcttctctctgtccctcagtctctctctcatctccctcaattagggccatgattctcttccctaaacttacttagccttttgcaatttctggcagcatttttttatgtttgtgtctgactgactctctacccctgctggatcctctccactcctgttctcacttctatgaatctttgtataatcctctagactcattgatccctcctcatgtccctttcgtgccccttggtctatctgtctctgcctttatccctgtgtgcactatcaccaccccctttttcttttttcattttctctttctctcgactcaatctctgttttcatctctaccctgctccctttccctctacctttgatctctttttccccctcaatttctgttcttttaactctaccaccaccaccacatctttgttctctctctactttcctccttttatctttcctaaattttcttttcttctggcttttctcctagtcccttctccttcctcaatttcagactctgttcattcatcaatttaccccaaaattcaacaaatatttattgagtgcctgtgtgtcatttgctttctctttttctgatctctttgccccctttctcttctctgtcttggcctctgcctgtttcactaatccatagactatgtctttgtccctgttttccagccccactgggacttgctttcacctcttcctatatctgtgcttatccaagagacaggagcaaattcaaagacagcataatatcaggctggtggtacacattctgtaggacctagggcctacccttccttccggatcccttgatttccttaaactgatacatgtgacctcaagctccttctcccctctggctgatcctgcttaggaaacaccctgggccaagcctcaggagctctactcaatgacatatgtttgcattagcaggctgaatcttcacttggctaagaccaacattcttagaaagattcttggccttaagtattgatcaaagggttagtgggttggcagttctcatcctgccacacaaaaacacatttcagtgatcctcatcatcacagaggtagtcagtgccagaatgtgagtcagaatccaggctttctgacctccagttagaactgtttccttcacccctttgcccagtagtcagtttcctatttcttcctccctcatgttttattggtacatgttaacattgggaaagaagttctttccctggaagggcaataagagcatctcggaggcagcaagttttgggtgggaagctgaagacgaggatcaaaggcttggctttttgccaggccctcatgatggaacctcatctcttccatgtcttctgcaggactttaggttcaagatggtgactgcagccatgctgctacagtgctgcccagtgcttgcccggggccccacaagcctcctaggcaaggtggttaagactcaccagttcctgtttggtattggacgctgtcccatcctggctacccaaggaccaaactgttctcaaatccaccttaaggcaacaaaggctggaggaggtaagaagaggctgctagcaaaaggggagaatgttagggtcctggggtaaaagttccaagttatactggccatctttgcctaataattaggacggttcatgtgaaaagtgtcaagatagcatgaactggccccaaaatatacccagaatctgtcttctgccaggttctctagaaagagtctcattctcggccaggcacagtggctcacgcctgtaatcccagcactttgggaggccgaggcgagtggatcacgaggtcaggagttcaagaccaccctggccaagatggtgaaatcccatatctactaaaaataaaaaaattagccaggagtggtggtgggcgcctgtaatcccagctgcttgggaggctgaggcagagaattgcttgaacccaggaggcggaggttgcagtgagccaagatcatgccactgcactccagcctgggcaacagagcgagaatctgtcaaagaaaagaaaagaaaagaaaagaaacagtctcactgtcatgtccctcacacactatactccagacatgctgaaactacttaaaattgcctaaatcaactattctgtcaagagtttgtgcctttgctcctgtcagattaccctctcctagaccctgtactggagaatctcatacttctcatttgacactaagcttggccatcatctcctctgcaaagcctgcttagacctccaaactgtctaattccaattctggctcatttcccctccctcttctggacttctgtagcccatgtacttcctctatcccagcactgttcacaatgtgtcttcagtgtatgccattcccaccagtttagtagctcccctagcacagggaccagactcatctatctctgtgtctctacaatagcctgagatagggctttaggggtacattagatctcagcaattattgttgagctgaacttatgactagaaatgcaccccaaattactctcttacctttgcatagattctccatcttgggcgaagggccactgtcccttcatgctgtcggaactccaggatgggaagagcaagattgtgcagaaggcagccccagaagtccaggaagatgtgaaggctttcaagacaggttggagtcaagttccaccttatgcaacctttactcctaatgcttgaacacactacgtcacagtcctgagctaggctaatacaaaagcagccagtacacatcccatgatgagaagtccagtctttccaggggagccatggtaggcaacagtttaggctgtatgctgaagcacaccatacctgacaaacacatatgtacgggctcctgaaacttttagtcattattctaagatgagccctctagaattttgactcctctttttcaggtggctaaactgatcccaacaggctggggtcccacatttcagcaagaccactctatgagaatatggatttgcatgaaagagaaagagctgggagtaggtacctcctttaaccagggtgcagatccccaggtcaacttaattagtgcagaccacccaagataatcacccttgagatatggccacactgttgacatctttcataggcccctttgggatatcattaaggacaaaaacttcaaaattgaaatttaatgatgtttagaaaagaagagtaaggtacattatcctgcatctactttctaaatgcaggacccagggtggctgctccagttacctgagccaagggaaaatcctagtggagagaagtatgattcaccttatagaaggtttcctaacaatgtaatagtctccattcggggggataaatagaagctcaccttggagaagatttcttctcgctgtagaagctgcccttaccttataaacttgaattttcatgtgttgcattgagcttaaagaggacaacacatgctttctttttcccccattctcttcacggccaatgaatctcacattccgtctcagatctgcctagctccctggtctcagtcagcctaaggaagccattttccggtccccaggagcaggagcagatctctgggaaggtcacacacctgattcagaacaatatgcctggtgagtttgctgaggtggaaaaaaaggggaccggaatagggaaggcattctgaaagggcctctgtcacagtaggggaaacagtacagaagggccttggaaccaaaggaaatttgagtttaaaatttaatgctggcacttgctggatctaggtgttttggcaagtaagacactttccttcagtggcatttaatacctacctcaataggttaccatgagaagaaagtgaaattacatttatggaagtgtttctaatgaggcttcattaaatattaggcttatttccattatttcttctctatgcttccctcaaaaactttcacccttcatacagcaccttttccccattcttatatgtgtttatattcctttccataatgacatttacattattttctaatgtaaaaggaatatgattcatggtaaaatatttttcaacatatacaggaaagtataaggagggaaatttaagtcatgcagagttccaccattaagtttttgttatattttctcccagatatttttctatggctacacacacacacacacacacacacacacacacaccctctgctctcttcaccacacccatgcttttgttagaagtgtgatcttattttacctggagttcgttatgctgttttgttcacttaaaaatatgtcatgggtatagtatggattcaatatcattcagttaatcaagcatctataatttaagttgtttccaattttttgtattctctcagtttagattgtaggttggttttacatacatacaaatgtactcaaagaaaatgtatagtattacttttttcaatttttatttttacctaataatatcttgctatatattttactctgtgcccttttttcactcaacaatatactgtggaaatgcttccactttaacacatatgtatctaccttatttttcaatgcttcaaaatattttgtagtatagatataatagagattatttggctactcctctatttggttgcttccaattttttctattacaaacagtggtgcaacaaacatccttgaatgtatctccttgtgtacacaggcaagtgtttctccaggataaacactcagtggtggaaattcttgggatgtaaggatgtgtacatttttgatattaatacattttgtcaattagccctccaacatggctgtaccagttatcaaggagggtatccatagtctcatacccttaccagcccttgatattatcaaactttaaatctttatcaattgataggtgaaattttgttttcccagttttatttttcctgattaagaatctttttctacatttattgaattgtctgttcatattctatgcccatttttctactgagttgaaatttttcatgttaatttttcagagattatataataaattctgagtatcaatcatttgtctgttaagtatgctgcaaatatttctctagatatgtcagtatgtgcatttaaaaaacttttgatatgtatttccaaacatctctgcagcaaggatgttaccagtttgcacctccagcagccatataaattgctgtctgcaacatgatttctgtctcacgtaaagagttctagagtttaacaagctctttggcaaacgttatttcaatttatcctagaaataaagttaccccattttgtagtggtaatggttaaagaagtgggctctgagttacttacttgatgaacacttacttgctgcatgaccctggtcaagttgtctaacacttaatgccccagttccctcatctgtaaaatggagatactaatagaactgtccatggagcattgttgtgaggaataaattaaatatttataaagttcctaggaaagaacttacatgtactaggcattcattaaatgttagctataatgatgtaattgaatattagctatctttattagtattattatgactactaatactatagcagtaataatactactattaccatgtgccatttattagtttgaatatattacatgttgttggttgtcagatgctcacaactctccaaggaaagtattattagcctcattctacaaataaagaaatttaaagtaagaaagaagattcatgacttgttcaaggccacacagctaggaagtggcaaagagatcgctagaaacaagatctgttgatactccttccagtgagactgaaagcagtgattctagtaaggaggctgccacaccaacccgggaagagagatgaggccataagaaagtctaaatgaatgtgtgaatgaactactgagtgaatgagtgaatgagtaagcaaaaggatggctgaatgaagtagtagagagttaatgtggtccataagtcaatgactgagcaaataaatgaatatgtggaaaaagagttggagaactcaaaatcagcaacatgggtaaaatacagactagccagggagagacttaaaacgaattcttttcatcctcatatctgctcctgcaggaaactatgtcttcagttatgaccagtttttcagggacaagatcatggagaagaaacaggatcacacctaccgtgtgttcaagactgtgaaccgctgggctgatgcatatccctttgcccaacatttctctgaggcatctgtggcctcaaaggatgtgtccgtctggtgtagtaatgattacctgggcatgagccgacaccctcaggtcttgcaagccacacagtgagtagtaggctttcagccatcagcagtggccagaggagatgaaaaaccacacatggaaaaaaaaaaaaggcagagctggcagtggaaacttgggttctatcaccacttcttttgtccaaggtcctccatcatatctattccttggatatgaaataagtcaacacaccatgtttcccaaactcttcggtgtccaatgctatggaggggaaggatgggagaccaagcaaggcccactctgcctgagtttttaatctagctgcagaattagtattgccagagatggagtgtgacttcctctaggtcttccaaactactcaagctcaacctagcttctccctctctccctgagtacctccagtcctagaaggaaggcacatgtctccctatcctccccatccttccctctactttgtctcataggacacagtttatataggatcactaactcaacattgactcccatcaaggaagagaaacctacccagttcctcgatgcctgacaagagtttctttttctccttttctcctgttttctcctggccagggagaccctgcagcgtcatggtgctggagctggtggcacccgcaacatctcaggcaccagtaagtttcatgtggagcttgagcaggagctggctgagctgcaccagaaggactcagccctgctcttctcctcctgctttgttgccaatgactctactctcttcaccttggccaagatcctgccaggtaagcctgaggcctgagctttgttcagggctggtatcctgcaatacagcatccagtttcactggttccatcactccttccctgtatttggagttccctcactcccattgttcttccttcttatccaccttgcatatcctcaacactggataattatatccctctgctttctctccttctgcacgtagagaggaccattaccggggaacattaccccacctcacagaaaggaaacactataaattcatcacctcccaactcaactgagctcttaacacacatacatagttattttatgtctccacaggagctttttcaaacttcttctcctcttctaaaacctctgactaccttctcctccacacttagcaaataacctcacatcttacttcacaataaaaacagaagccccagacagagaatccttatttattgccaccaaacctacgaacttatctaattgtttatctagccttgcctcattctttccttttacaatggaaggcatatctctccttctgcctaaaaccaatcccttcacttgtacactggttcccatattcccagtctcctactctctagtctgtaatgtcctcacctcatacgccttgttgtccttccgccaaggcccaatccagaatgaatacaaccctccatcttcactatatcaattccgggctcatacagttgctcagacaggagtcactaaaaattcatactcttaacctctactgggttctccatggtctctgacaatcccatttccctggtcagttctcgaagtttatggggcagttttgccaaaccaccattatcctcagccttcccacaccccctcctccccatctccctcagcagacaacttcatgttctactacattcaaaatagaagataccagacagcaatgtccttgactcccagccacaaagcacctacaaactcataagcatcttcaaatgtcctctcctcactccttctcttctgtcatagtggaagaagtatcctttttcttgtgactaatccttccactgttgctctgtgccccattcccctctaccaccttaggaatcttgacctattggctctctcctcctctcctgtatcttcagcctctccctctctttaaacatgttttcaagtctcttgtatcttataaaaaaacattgcctcaacccctgatcactctctagctactgccctctttcctccctataacaggcaaactgcttgagagaagtcttcgctcttactatctacttcctcacctcctgctgattcttcagcacagcaaaaatattaccaccacttctcagaaactttttttgagtccacccataagccccaactaaactcaacatctttaagttgtttttagtccatcccctcctcaaccattaaacttctttccatctctactgccagcatcctagcctgatccaacatcattttttaaagaaaattttacctttgccctccgataatctattctttacaacagtcagaattttttttaatgcaaaactatctttgtcaccccaccctcagccctggtcaaaaccctttagtggacccccattcccccaggaccaaatccaaatttcttatcacagcttctaaagttctcaataatctggcttctatgtatctcttcggtctcacctttttgcatccctcctctcactatttcattcagtaatacattcattcatatactcattcacttacttataaatctgtcatcagtttatttatccattcatttaataaatgtttacttagcatctactgtgtgcttactcttatactggacaccagagacagagagataataagatgtttttgctcccatgcaactcccagtctgcttgtctttcaagccattttctccagaaagccataactcattttctcaggtggaagttatcccttaatcttataataaggccacagttccttgatggcagtgcagttggtggcaggggttggggaggtccaggaatcaactccctctaccaatttcacatgcccacctgccccaccaggattgcccagtaaaaagccctgcattcttcaaatctttctggaccttagctttctcacttgtatagtaaagggatgaatcccatgatcactaacagccctgccagctctgacatgccataagcttatgattccaacagtaaaagcctgataaatatccatccctgtaaccacaagcagatgctacctggaatggatggaatttcatctagactaggaacaatctagcatcagtccgagtcaacaaacattccctggggtaatccctttttcaagtcttgatcttatatattggggagaaggaaaataggtcccgtcctcaaaaaactctgaagcttcttgggaaattaaatgttcttccaccccaaggcagtcagaggctagaccagggttacaaatgactggagggaaggatgtaggggtcagaatttgggaacagtgaagtccttccaagggagaaagaagtgtcacaaaagttcccagagaaggaagaagcagagcaaggtcttcaaagggaagaaagggttggcccttttctttgccaggtcaaacctgaaggttgaagtgggagtactgggacagaagcttaaggattatacatctgcttcctcagggtgcgagatttactcagacgcaggcaaccatgcttccatgatccaaggtatccgtaacagtggagcagccaagtttgtcttcaggcacaatgaccctgaccacctaaagaaacttctagagaagtctaaccctaagatacccaaaattgtggcctttgagactgtccactccatggatggtatgtatatgagtgagtgtatgtttactagtgttggtctcacaaaaaccatgatgatcatgatgatgatgatgacgataacattataacagctaatatttatagtgtttattatgtgccaagcaaaattattagtattttacatgtattaattcatttaattttctgaacaattctatgtgataggtgttattattattttgattttttacatgaggaaactgagacataagagtaatttgtccaaggtcacacagctagtaaatgccaaagaatggaggcagctattacattcatcttataggtaaagaaactaaagttcagagttggcatccaattcatcttgagtggctcagcaagttggtgctaaagtgagtatctgcaccctaacacatataactccaattcctcgagtaacacttctcttgttagaaatgatatgtaaatcaataatcccagtgtttggtttttatgaaggaaatttcaaaaaccattgcctaggatttttttcaaggtccagtatgaagcattggggtcaaaacaggttttcaagtcagagagacctgggttcaaatcccacctttgacagttactggctatgaccatgggtaactctttaactgtctaagcctcaattttcccaaaggtaaaatatctggttgtaagaattagagatgatagaaaccattctagttattatgctttagtagaattaaatgatcttcacactcctacctcctttctttgctcaattgaaacaatgtccaaagctttctattgctggccctgttgtgtagaaatcatgtgttttaggcatcctcttatggatttatttaagggaagaggtcctcaactcatttcagtttgtcccttttccaactgaaacaaaagagtccatagtattccctgatttaggtatcttaagtggcatgtaatgactatacacacaggctctaaaaccagactatccatgttcaaatcctagcatgaccatttactagcttgggcaagcttcttaattgctctgtgtctcagttctcagttgcttatttgaaaaatgtaagtgataataattaaataggtatgcaaattaaatgagttaatatatgtaagaaacttactattatgcccactcccacatttctaacactagcaataaagtaaaactatcctatcccttttgtatatttctaccactgagactattcaaattcattatttctctagtggaaactatgttggtaccattctacctcgttacatttgcaaataaatagttatttacctatttttggggtgcaaactctgcccaaactgttgatccttaggctgaatctctcccattgaaatgatgctaggctgaacacagcagaaacaggaaaatagacattgtcagaatgaagtaaaaacagaaagacaaagagtcaagccttgatcccaggctggggaacacacacacatgcgcacacacacgtacacacacacacacacacacacacacacacacacacacacacacacacacagagagacagagagagagagagagaaggcagggatgagatacaggcaatcgatccatacacagaggtttgtaatagttctaaatgaaggcgcacatcctccttcctctctacaacacccttttccaacccaaagtaggcatgtatgggaaattccacattggagatggagctggggaagggttatgatgtcctacctctatcccttggctttgctcaggtgccatctgtcccctcgaggagttgtgtgatgtgtcccaccagtatggggccctgaccttcgtggatgaggtccatgctgtaggactgtatgggtcccggggcgctgggattggggagcgtgatggaattatgcataagattgacatcatctctggaactcttggtaagtgaatgctttgggccttcttatataccctccagagaggaggcccttacaaaattcttttctgcctcctccccaaagctataggggttgtttggacagaattcacagccccaggctgctgccatcctggactccctctctccactcgcatcccactgcagagttgatgagaaagtctggtagagttttttgaaaagaccttgaactaggccaaatagttagattcaacttgagtatgtgaagagctgtgtttctaaacccctcccccaccctagccccaagcttcatcttagctccactcctgaccctatccagctaaaggtccccacccagctcctgcctatctagtcattgcatatggcaagacttgaaagtcctatctcaaagcagcagaattatcagctacgactgccttgtcatggacagatgagcagaggcctgggaagacagcctggagccccaacttctggtgcacccccttgtgttatctggcacatgatcctgttgctctgggactgattatgggatctgtgtatatcttattcctttctgtctccaggcaaggcctttggctgtgtgggcggctacattgccagcacccgtgacttggtggacatggtgcgctcctatgctgcaggcttcatctttaccacttctctgccccccatggtgctctctggagctctagaatctgtgcggctgctcaagggagaggagggccaagccctgaggcgagcccaccagcgcaatgtcaagcacatgcgccagctactcatggacaggggccttcctgtcatcccctgccccagccacatcatccccatccgggtgagagccccaccatgcccattgccctctccacctatttattctgggagcctcacgctcccaacaaacctacatctgttgctgtcttcaattatttgctttcctgctaaccattccctttattgccagctttgtttccctttttgaaaaattatcagccattctggattaaccagtcttttccttgcatcagccattacctcatgcttattagattatcctaaccctaacaatagcgagtgctcacagcctataattcagagtttttcaaactggatcaagacaattaatgggtcacaaaatcagcttagtgggttatcattagcattaaaaaaagaaaagaaacagaaaatgttggagtacatcacatactaagggtatcatcaatttgtgaaaaatttgtatgcattttgggtatttgcatatacacatgtatgtgtatgtgtgcgtttatggtcacggtgtaaaacgtacttcttattgagaaatgagggcagaaaaataaaatcaaaagccataggattagctgctactttggatcctcaatatgagcatttactgcctttaaaaatgaactgctacttctttcttaaataacacgtatttgtgtgagtcagtaagccagggcagggaaaggacacttatttgtgacaattttgtggatgagaaatagtcactgctctttagactaacctagtatttcctttaaacactcattttatgaattaatttagtgacagcaccccagaattggcttggcgggggttccagaattggcttggtggggggtatcttctcacccagaaccatcccaaactaagatattagctaagtaaaatcagtgtgcttgctctgcaaacagcttccaaacagggctcctggtaccacctctgctccatccttttcaaaccaaattgctagctctgagctcctccttgatagaaattctggagctgccactaagcccctaatggaaaaaaaaaatctatcccaaaattcagtgatgttccctcatctagttccctccatctgcttaatggagctagtgatggtggagccagagtggcaggtactgattagcctttctcctgagtccaggtgggcaatgcagcactcaacagcaagctctgtgatctcctgctctccaagcatggcatctatgtgcaggccatcaactacccaactgtcccccggggtgaagagctcctgcgcttggcaccctccccccaccacagccctcagatgatggaagattttgtgggtaagttctcaacatgggtgcctacaggacctccctcccctcagccccaggatctgaaagagaagctgagaggacagagaccactgagtttacaaaatatttctggaacatctaatgtgtgccagcacctatactagggtcacaaataaatgagaagcagcccctacacttgtagggctccagtttggttggggataccatagtgaacacaaacaatgacactaagggatgatcaaagctccacaaggcagtgcatgatagagttgtcggagcagagaggaggggcctgactcagcctgagggatgcaagacccacttcctagtagaggtgacacctgagctgagtcttgcaaagtgagtggtattaaaagaaagagggcatggaagaagtattcctaccagagggaagagcatgaagataggtgaggagaatgagaagcagccagggatatatcaagaacaataagcaggtggtattggaatgtagggtcataggaatggagtggggcaggggagtatcaatctatgagtctacaaagacaacatgagatagagactggattgagaggcttgtagagctgagtagtttgagatttaccctgaaaatgccagtttagtcaattcacctaatgtttgttggatttctgttgggtagttttgtttttgtttgtttgtttttgtttttgtttttttgagacagagtctggctctgtagcccaggctggagtgcagtggcacgatcttggctcactgctacctctgcctcccgggtcctggctcaagcaattctcctgcctcagcctcccaagtagctgggattacaggcacgtgccaccatgcctagctaatttctgtatttttagtagagatggggtttcaccatgttggccaggctagtctcgaactcctgacctcgtaatccacctgcctaggcctcccaaagtgctgggattacaggcgtgagccaccatgcccggcctgggtagtttttaatgcagggcctgacattgaataggtgctcattccaggcctgttggatgaaagacatgtaggcagttgatggtctagcagaggagccagatatagatggtactggtccagtatgatgagctccagtattctgggagctagagggagtggacacattatggagagagagggtgggaaggatgaaattggagaggctttgtgagtaaggaagtttttatgatgcatgttgaagtacatgtgaatatgttgtaagaatattccagaataagggaattccacgagcaatgacctagagataggaaagcagtgggtatgtattgacaacataattctgtttgtctgaagcatgggcagtatgagaattcaaggaagacaagctaggtaggcgccattcattcattcaaaaacattaaataatgctggctaacattaagtacttaccatgtgccaagcactgttctaaacactttacacgtattaactcatctaatccccacaacaacctcaagagttagagatcctcttatcatttccattttgtacatgtggaaattgaggcacaaaaatatatagtcgctgatccaaggtcacacagcttctaagttgcaactgggaggtctgtctctacctccatggtcataactgctaggtctaccacctctctgagctgatgacccagactcctgggccttttgttcagtattctcttttgctctgggcttcaattgtagagctctcagtattcttggttctctgaatgtccacctaggctaggcttttgtaagaatatatgaggcatccacgatggctccaccagtccctaagttccatagccaatccatcctgaaatcctgcaaaagttatctataatctctctcaaacctatttgcttttctcccctgccacttctttaatccatgtcaacatgatttttttcctaatttctctgcttctctcttgctcctctcaaatcctttctcgatgatgaccactagagggatttttctaaaattctgactatattgctcccttgcttaaaccccttcatgtttccctctagactctaaagcagtgacctccaaggggtatgcaaaatgattacagggtgaaggaacagaatatgtattagaattttatgtttttttatcttaaaaataggaaatcaagcatcactgatactgatctttaatatacagactgacagttatacatgtatataatatataaacaaatatagagattggaggtacatgctaaaacatttgtactgatagggatgtatagtccaaaatttggaaacattgacatataggacagagttgaagctcttcagcatagcattcaatgccttccacatggtgatctctatgccctcacctcctccccacatgcattttgttttttcagctacactgaaggacttgtcgttccctcatttttttctgctctcttacctctgggactttgctcatgctgctctcttttgattggaatgccctccctcacactttcctctggcttactttccttcatcttgtagacttaacttaggcattctttcaacaaatatttattgagtaccaactgtgtactagatactgttctaggcactggggatgcagtagcaaacaaatcagacacaaaattcctaccctctggagcttacattctagtggaaggggtagtaaaaaaaattaccaaaaataagcaaattaagtagcacattagttctaagtgctatgggaaaaaataaagcaggataaggagaatgggataaggggccaggggcgagttcagagaagggttgtagtattagagtggcaagggtagaagacgctgaggtgaaacttgagcaaaaatttgaaggaggtgaagttagtgaggcagatatctaagggaatggcatcgcaggcagagggaacatcctaaggcagggaagacacaggagtattccttttatatttgaggaacagtaagaagatgggtgtgggtggaatggtataagcaagtgggagacagaaaaattgagtacatagaggcaatgtgggaccagattgtatagggtatggtaggccattagaaggagtttggcttttactctgagagcccttgaaaggatttgaacacaggactgatatttctgactcgggttttaacaaaattgctccaacttctatgtagagaatacactaaaagggagcaagggtggaagcagggagacccaagagtgggctacagtaatatcccaggtgagagatgatggtggctcagacttgatcataatgaaggcaataagaagtggtcagattttgaaggtagagccaagggtctttgctgatagatgggatatagggtaagagagaaagagaaaaataaaggatagctctgaaatttttggactgagcaactggaattgccatccactgagatgggaaaagctaaaagtagaatagcttggtggagggtagggacatgagtagctcagttgtactcctaagttagaaatgcatattagacatctaggtggagatggagaaaagccattggatatacaagattggaaaccagtagagtggcgtgagctggagattaaaatttctgaaccatcagcatatagatggtctttaaagtcatgtgactagacaagatcaacaagggcatgaacacagaaaaggccaagaacagagccctggaacgtacctggggtacttcctccagctaggtcaggttcccttctctgggttttcacacccccaggtggaccccctaccccaggtttcctggtcatagcaccaatgacacagtatagttactgtcattatcattgtcctcatagggcttagagttcccaagcagacagtcattcttgggccacagcacatcctatacttagggagtggtccaggccaggacagtatggcttcaaattgtgtcaaaggagagcttccaaatcttttataatatatatcccagcatccagatacaaatggtaatattcacggcacacacagaagcaaacagtaggctacttctggccctgaggtatcttgaagggttgagggggatcaatatcttggctcatctgtactgtgacagatttggaagatctagtctaacccattttttccctcccctccccctaccaccttcagagaagctgctgctggcttggactgcggtggggctgcccctccaggatgtgtctgtggctgcctgcaatttctgtcgccgtcctgtacactttgagctcatgagtgagtgggaacgttcctacttcgggaacatggggccccagtatgtcaccacctatgcctgagaagccagctgcctaggattcacaccccacctgcgcttcacttgggtccaggcctactcctgtcttctgctttgttgtgtgcctctagctgaattgagcctaaaaataaagcacaaaccacagc

SEQ ID NO: 3428 - DNA, 70 bp, human
gttaatgtagcttaactattcaaagcaagacactgaaaatacctagatgggtccacacgacaccataaac

SEQ ID NO: 3429 - DNA, 1523 bp, human
cagtgagccgaaatcgcgccactgcactccagcctgggtgacagagcaagattccgtgggcttggtggaggggcaggattccgggcaggagccttgcctctcaggtggcgggctctgcgaccctgtgagatggacgggacggaaggcagtgtcgggcagcccggccccactgagcggtcccaccgaagcagcgtgtcctccgtgggagcccgagcggctgacgtgctggtatacctggcagatgacacggtggtgcccctggctgtggagaacctgccctcgctccgtgcccatgagctgcactgcgccgtccgcgaggtcctgaagcttccggacatcgccctggatgtcttcgcgctctggctggtctcccctctgctggaggtgcagctgaaacccaagaaccagccctacaagctgggacgccagtggccggagctgctgctgcgcttcaccagtgccccggacgacgacgtggccatggatgagcctttcctgcagttccgaaggaacgtgttcttcccaaaggggcgggagctccagatccccgacgaggaggtcctgcggctgctctatgaggaggccaagggcaacgtgctggctgcacggtacctgtgcgacgttgaggactgcgaggctctgggcgccctggtgtgccgcgtgcagctcgtgacctaccagcccgactggccggcagcctgcgacctgagggagaagctggactccttcctccctgcccacctctgtaagcggggccagggtctctttgctgccctccggggccgtggggccagggccgggccgggtgagcagagcctgctgaacgcctaccgcaaggtgcaggaggtcagcagcgacggcgggtgtgaggccgccctgggcacccactaccgcgcctacctcctcaagtgccacaagctgcccttctatgggtgtgccttcttccacggtgaggttgacaagccagcccaaggctttttgcaccggggtgggcgcaaatcagtttctgtggccatcagcctggaaggtgtgcacgtcgtggacagcagagagaagcacgtcctgctgggcctgtgcttccaggagctgtcgtgggaccacacctcccctgaggaggaggagcccatcctgtggctggagttcgacagggacagcggggtcacacctgtcaacaagctcctcaagatctactccaagcaggccgaactgatgagcagcctcattgagtactgcatctaactgagccaggcggcggagcccgcaggcccccaggacagtgcaactggctcgccctcagacctcagctcctcgccagctcctgttcagcgccccaagctgcggaggcagggcagtgtggtgtccagccggatccagcatctctccaccatcgcctatgtggaggacggcaaggggatcaggcgagtgaagacgaagagcaccacgtccttcttcagccagcagctgtccttgggccaggggagctacaccgtggtgcagcccagcgacagcctggagcagggctg

SEQ ID NO: 3430 - DNA, 982 bp, human
gcaaacggaaagactacatctcccaggccgccacgctttccagctggagtcctagggcgctgactgctccccagtttccgtagggaagcgctgggctaccgcggctattgtgcgtcgcgctctcgccctcctcttcccgctgcagtgtctatggagcgaggctacgtttcattgccgccctggcttaacccttccggcgcctaaaaggacggccggccggccggctcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacaggtacctgtcctccaaagggacggaggctatgagcttccttaagcgggtcgcgcgctcagtccgtcccctctacttcctctactgtgccattgatgctctcggtctttgtgtctttcccctttccccctactcccggccatcagaaccatgggtcatcccccgctggagttcagcgactgctacctggacagccccgatttccgcgagaggctcaagtgttatgagcaggaactgga

SEQ ID NO: 3431 - DNA, 386865 bp, human
agtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacaggtacctgtcctccaaagggacggaggctatgagcttccttaagcgggtcgcgcgctcagtccgtcccctctacttcctctactgtgccattgatgctctcggtctttgtgtctttcccctttccccctactcccggccatcagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaagtaagtgcaaggcttcgatgagctgtttctctgagctggtgtgtctggcctttaagcctttccacaccaccaggggaagggagattgcagggtgactcccagcccagatctctgaggcaaatgggtttcccacacttggggagtggagatagtagaagtggaaagtggtggatacaaccagaactttgggccttttcctttagtggttttgaccttataagacgtgatccgtagctgtgccagggaccctcttgctcagcaattacccttacttggcagatgattgttcttaagggacaatctgctgtactgttagacatattcagcacccctgtctggggcaaagtgacatccaagctgaccaaggaactgccccagcacctcctaaacaattggggattaaggtcagcagcttgaataataattttgtcctggtctctggttgctacagataagtgtggggggcagtaaaaaattcgccatggcaagttattttttaaggaaagcacctttgccccagtgaattattttctttatcacactgagctatggtttaggtcaaggtcagtctaagttcaggattattggatggcttcacctgccactgaattctgcttgagtgtggaacaaagagctgactacttagtccctgccacaaggggcccagcccccagggagtaaaatagggatagggttgggggctgctgggctgaaggaacttcacctagcttcgcttttccagtgctcacagctgactcagctgtgggaagctctctccttcccccattgtgtgtggaggttttttttctgcttgttggtaggaggcttggagtaaaagaaagaataataaacatccccaacgagagtgcaggcaagccaaccctttatgccaaagcatatacacagaagaatggagggtaatgattgggtggagtgataattaattttttctcttggctgaaagatgattgtgaaaaataaactcagagtcattggcaagtatgtcctatatggttataactttgttttgagtgaatttatcaccaaatacagggtctaggaccagtgtggcaaccttcttaggcggatgcagtcaaccaagagcagggagaaagaaagatttgaaagtggtagtgcgaggctgggcgaggtggctcacgcctgtaatcccagcactttgggaggccaaggcgggtgaatcacctgagatcaggagttcgagaccagcctggctaacatggtgaaaccctgtctctactaaaaatacaaaaaaaaaaaaaaaattagctgggcatggtggcaggcacctgtaattccagctactcaggaggctgaggcaggagaatcacttgaacccaggagatgttggttgcagtgagccgagaccgtgccattgcactacagcctgggcaacaagagtgaaactccatctcaaaaaaagaaaagaaagtggtagtgtgttggtaactgctgccagctggtatttcttgtgcagcccttctgatttgccctgtggagtcggtgcttttccttcacatgctctctgcccacttttggtcagaatatgtacactgtcgaagttcctgcaggtcatttgattgtgtttgatcttttaatgatttgtcttattgtggcctgaccaagagtaaactcctagtagtatctgaaatgctgatccttaagaggttaaggatatgcaggttgtgctacataagtagaaaggtgagagttcacggaaaggaaaaggaggaatgtttcagctttgttttgttttgtttatatattacagtaaactgcttggtgctgtgtccccagtaaaacgaatctcatcataagccctaggaacagaatggctttgtgaagtggatggtaactaaaagcatgctaaaaatcaccagctaaggcatatcagagagattaagatttataagaaaaaaagtagttcaataaaacatggtggaagagcaaaagtttcataagctaggggcaagtaaaggtttttattctttccttttctttctttttttttcaatttttgtttttgagatgaagtcttgctttgtcgcccaggctggagtgcagtggcatgatctcagctcactgcagcctggatctcctggtttcaagcgatcctcctgcctcatcctccccagtacctaggactataggcatgtgccactgcgcctggctaatttttgtattttttggtagagatggggtttcaccacgttagccaggctggtcttgaactcctgacctcaggtaatccacccaccttggcctctcaaagtgctgggattgcagggatgagccaccacgcctggcctctttccttcttttctaagactcaaagtgataagagtcaacagttaagcagatctaaaattttgcatatgagcagaagatccaagagatattctagattaggggctccttgaaatttgtggtagttttctgtttctgagtatacacagaaagccaaaaataggacaggtagaaaataaaacccagcagctaacccattctccatttctttccattcaattgcatggattctaaaagtctgattagctagaggcaaaggtaggatgtttcctactgtcttgaccacagtgatgtttatactcccactctccttcctcacactgtgccagcggagcgactttctgaaagtaggtagggtggaagcaaaacaaagttatgttcttgctctgtgttgaggaaaaaggaaaaaggaacactggaatcggagttagaagatcaggattatgttcttggcttctccatcttgggatctaacacaaatcactttttttttttttgtttttttctgagacagagtcttgctttgtcacccaggctagagtgcagtggcatgatcgcagttcactgcagccatcgccccttgggttcaagtgatcctcgtgtcttagcctcccgagtagctgggactacaggcacacaccaccagatctggctagtttttgtgtttttagtagagatgggtttcaccatattggccaggctggtatcgaactcatggcctcaggtgatccatccactttggcctcccaaagtgctgggattacaggcatgagccactgcacttggtcccacaaatcacttttcatttttcttgttttagagacagggtcttgctttgttgcccaggctggagtacagtggcacaatcatagctcactgtcacctctaattcctgggctcaagtgatcctcccacctcagtctccccagtagctggactccaagtacacgccactatgcctggctaatttttaattttttttagaaactgggtctcactgatctcgcccaggctgatctggaattcctgggctcaagcaagcctcccaccacggcctctcaaagtgttgggattataggcgtgagtcaccacacccagccaaatcacttttttttggagacagagtcatgctctgttgcccgagctggagtggagtggcatgatctcagctcactgcaacctccgcctcccgggtttaagcaattctcgtgcctcagcctcctgagtagctgggattacaggcacctaccaccacgcccagttaaattttgtattttttttagtagagacggggttttgtcttgttgcccaggctggtcttgaactcctgagctcaggcagtccgcccccccttggcctcccaaagtgcaagaattacaggcatgagccaccgtgcctggccccaaatcacttttacttcgtctgtaaaatcggggtaattatacccacctcccaagattgttgtgaggctcaaagaaattaatggattatgaaaatgatctgtaaatggaaatggctaaacaaagttgttgataatacatcttcggattcttaatatatctgttggtgaatgtgtcattttctgtaggtttctgaagggaaatgcataagcagaagtagttggaactcctcttgcttaaatgtgatctcttcataattgttgaagtgcaaggtgattataacttaaactaatggaaaataaaaataccatccctctgaaaggtgactatattgccaacttttctgtttgtcctttatttttatattggtagcttcagtccccaatgttgtttgaatatttgctaagccctgaggctaggcattattcagaacaagtgatgtggcccctgctcatatcacaaagcagcatgacacatctaataagtgttatatatagttagcgaatgcatactattcattcaatacatacttggacacataccgtgttcaagtcattgttcttggagctgtcaggcatacagaatgagtcacagatggatactgctttcaagaggttcttaggctggtgggagagacaagacgtggatagaaatgattgtcatataaggtagtagatacagatgagagccataaaagtgggaacaggtggacctgatgatatatgacatgagagggaaagctgatttcccagtgggagcacaagggagaagccaaggaagaagcaccatcagagttgggtagaattaataacactatcacttgtttagctgttcccatgtgtcaggcattacatcttgtaacagatttttgagataaggattattattcccattttttagatgaggaaactgaagttcagatgagttaagtaactttctcaactagtaagggcaagtgtctgaattagaacctagacctgactctaaaggccctgcttatcctactgcatgacactattcaggacagggcatttcatgtagcgggagtgacacagaatataaaggggacagcaaataatttgagtcatctggggtataggcaacagaaagggaggtttgggctcctgaggagctggattacagccaccatgcccagctaatttttgtatttttagtagagacaggatttcaccatgttggccaggctggtctcgaactcctggcctcaagtgatccaccagcctcagcctcccaaagtgctgggattacaggcgtgagccaccacgcccagcctacattcttttttttttttttaattgtgctagctaaataaaacattttcataggccagattcaatcaggttgcaacccctgagctaaatgatacagctctacaagtctggctcttggactctaatgggctaggaaaatagaggatgacagtcttcagataggggctttcctggggaagcaacaatggatactctttgcaaatgagcagaggcgaaatgatggtataatgggacaaaaccctggacatggcatctagatacctgagtaaggtgctggttctgttatgggatctgtgaccttgataagcgatttcactgggaccccagggtctgtggctttacaaagatggggctggggtgggaggtttataaacccactttgagctctaacattctatgacttactatgttttgcatggcatattatagtttcatgatttgagaaaggaatgactaacccaattacaggaccttattttacgcttacataaaatttcacattattttagtgtaaatgacagtatttaatttaacaaaaaattaaaacagaattttttgttgttgttgttgttttttttttttgagacagagttcactgtgttgcccaggctggagtgcagtggcgcaatctcggctcactgcaacctccgcctccggggttcaagtgattctcatgcctcaacctctcaagtagctgggactacaggcgcatgccaccatgcccatgctaagttttgtaattttttttttttttttttttagtagagatggggtttcaccatgctgtccaggctggtctcgaactctcgacctcaagtgatctgcctgcctcagcctcccaaagtgctgtgattacaggtgtgagccgctgtgcctggcctaaaagagaatttctaaatacccttttccaaaccaaggataatgtgctttataagtatgtttttgtttttttttttttgtttgttttaagagacagagtctcactctgtcacccagagtggcatacttttaagtacagtggcaccatcatagctcactgcaacttcgaactcctgggctcaaaggatcttccggactcagcctcctgagtagttgggactacaagcacacactaccaatcttagctaactaattttttttttttttttttggagagatgcggtcctgccatgttgctcaggttggtcttgaactcctgggctcaaatgttttttccacctcagtctcccaaagtgttggcattataggtgtgagccatcacgcccagcctctgtgtatgtatatatatatatatataaaacagatgtcagaaaaaaaatatatcactaaacccacatatatacgtgcacaaccacacatacataggctctcttggactaatgaaaactcatgttttttttgttgttgttgagacagagtcttactcagtcacccaggctggagtacagtggtgccatctcggctcaccgcaacctccacctcctgggttcaagcgattctggtgcctcagcctcccaagtagctggaattacaggcgtgcgctaccacgcccagctaatatttgtatttttagtagagacggggtttcaccatgctgaccaggctggtctcgaactcctgacctcaagtgatccacccatctcggcctcccaaagtgctgggattacaggcgtgagacactgtgcccagctgaaaacttatgttttaaaagaatccagggtcgggcttggtgactcacgcctgtaatcccagcacttttggaagccaaggcgggtgggtcgtttcagtctaggagtttgagaccagcttgtgtaacatggcgaaaccttgtctctacaaaaaatatgaaaagttagctgggcatggtggtgcgtgcctgtagtcccagttactcagggggctgaggtgggaggattgcttgagccctggaggcagagaggttacagtgagcagagatcactccactgcactccagcctgggctacagagtgagaccctgtctccctctctaaaaaaaaaaaaaaaaaaaaaaaaaaagaatccagtccaggtgcattggctcaagcctgtctcaaaaaaaaaaaatccaaaagatgcattcagtactctaaatgtacataaaattgataaagtagaaataattctatagttttaataactcaatcttaattttttaaaaaaaggtcactgtcttacattctttgcttttaaagttagagttttagatgtttacattaaggtcaccttttggggtacctttgcagctttcactttggcaaccggagcacctatctggtgagtggttgctttcctggaaggatgggttgattccaattctgccactagctagctatatgactttaaacatgtctttagttttgtcggtctcagttttcccattttataaaattagaggcttggtcaataatatttacggttctttctggttttattattttgttttctggctaccaccatgctagtcaaatggtcaaacaatgtgaattgattctatcataaactttaggagccaattcatcttcactctgggagaataggcaaagggaaaatccaagtagtatgtccagcatgagtagatgacttgctgacctacttgactatcctctcattgaatgcttcttggtaggtctccacctgattcccttcagttctgttctgaatagctctatactgagggaccccaaagcttttaatccctttgggatgggtgtagtgccatggtgtgcgggaggagttggtgatataatatgcattcttgctcagcaggtatcttgtcattttcccagtgatatttaatcagtgcctctgagcacatggagttattttacatcttctccagagtaactcagatcaatataatgggtatgtcatttggtactgctgttagtattaatagatgtgaagcaatgctaaatggaatttgacagaggtgatatattgccatattcattggagttcctcacaagaccagattccagagtagctggactgtggctgctgtgggaactaggattgaaaagtgaaccaagccaacctttcagtgtgtccatttataagaaactattcttatttgggagtagaggatggtgccaggctggggtagggaagattttagcttgacttgcctgttaagaaaagttttccaatcagactctagagtgatgaaggaactttacctttcagcctcatttttatagccttattttttttaagcatagccaaaaccttttgtttaatctggcatctgtttctctaatcagttactacagaaatttcctaaaagcctatgaggatctggaaagttacacacttttccatgggagtaccctggaaatcttgagctgattttattttctagtggagtggaaggccctcatgatcctttaccaggcttgtatcaagtgctaaaccttgggcaatgtaaaggcaattcagtttaattcaagaaggttttactaagcacctactatgtgtcaggtactgtcctggaaactggggatacagtggtgaataagaatactatagactctgcccttttggaacatatgttaaatatcaaattaccctcttaaataattaattacaattgtgagaagagtatgaagaggaaattcagtgtgtgattttttttttatttttatttttatttatttatttattttgagatggagtctagctctgttgcccaggctggagtgcagtggcacgatcttgactcactgcaacctccgcctcctgggttcaaacggttctcctgcctcagcctcctgagtagctcggattataggtgtccgccaccacgcccggctaatttttgtattttcagtagaaacggggtttcaccatgttggccagactggtgtcgaactcctgacctcaggtgatcagcccacctcggcctctgaaagtgctggaattacaggcgtgagccaccatgactggcccatagtagaattatttataatggccaaaaagtggaaacaacctctaaatgtccatcaactgaaaaatggataaataaaaggtagtatagacatacaatggaatagtatttggcaataaaaagtaatgaagtactgacacatggtacaataaggatgaactttgaaaaccttaggataagtgagaaaagtgttataaatgactacctattgttcatgattcctttcatatgaaatgtccagataagcagatctattagagagagtatcaggttagtgattgctaagctggggggttggaatgtattgggactgctaatgggtaaagggtttctctttggggtcatgaacattttttaagattggattgcagtgatggttgtacagctctgtgagccattttatggtgtgtgagtcgtatctcagagctgtttgaaaaaaaaaaaaacattgtgtttggagaaacaggtgacaggcgcttgtcttatatacctatatcttcctttagctctatcttatagaacatcagacctggaaggttgtttagaaagctacacatctatggctgggcgcggtggctcatgcctgtaatcccagcactttgggaggccgaggcgggcagatcacgaggtcaggagatagagaccatcctggctaacacggcaaaaccctgtctctactaaaaatacaaaatattagctgggcgtggtggtgggcgcctgtagtcccagctactcaggaggctgaggcaggagaatggagtgaacccaggaggcggagcttgcagtgagccgagatcgagccattacactccaacctgggcaacacagcgagactccgtctcaaaaaaagaaaaaaaaaaaaaaaaagaaagctacatatctactccactgggtttatatgtagggaaaagaaagtcaagacagagagttacttctccagagacctagagctagagtcggaattgtgaccagaatcagatttcctggtttccctttccaaggccttttcttttcttttcttttttcttttcttttctcttttcctttcctctttctctttctttctttctttttccctccctccctccctccctccctctctctctttctttcttccctttccctttcttctttcatccttccttccttccttccttccttcctttctttctttctctctctctctttccttctttctctttcttccctttccctttcttcttctttcctccctccctccttccttccttcctttttctttctttctctctctctttttcttttctttttctttctttcttccctcccttctttctttcctccctccctccctccttcccttccttccttctttctttctttttctttctctttctttttctttctctccctctctctctctttctgtctgtctttcctcattgcaaccttgaatcccaaccccaagcgatactcccacctcagcctcccaagtagctgggaccacaggcacgtgccaccatgcctggctaatttttaaattttttgtagcgatgggattttgttgtcttgttgcccagggtgctctcaaactcctgggctcaagcgatcctccacctcagcctcccaaagtgctgggtccaaggctctttctgcaagcaggtagcttgcatttcaactgtcttgatgttctttatcggggctaggggtgcttttgtttgaaatgacccagatggcagcaaaaattgcattagtggaaggtttcttttcagtatttcctccccattagggctaggatcaagtgatttccctgttgagcaatctagctcagtttaattagggtctggttgtgttctgtttcctttgtcatagaataatggcaatacatcttggtggtgtgatacctgtcctctttgttttctgccccaagagcctacaccagctggttgagcagttcccaaagtctcccctctttgctcatctgtcgacctcttagggcaaacacagctgcttttcatgtagtgagtagtatatattgggaaacgtgtggcattactaacgagtgacaaagtccttccccatattatttttatcctaaggcagcttggaatttttcacaagtggtgagcagtaagtccagcactatagtgccatatgaggaactccaaggcagttctttacaaaaggttttcattaaggacttcccagaagcaggagggccacacttcaacttccaactctttccagagccaggctgtcatggaaaagcttttctctgtgattggaaaaatatatattatgtatgtggcaattgacagctggagactaatcttgaattcatccatcctgaattcattaggtgggaggaagagggtgggtaataaggcattgaggtgttttatagctgccccttacaacttttgttgagtacagaaaaaaaacaaaaaacaaacctggagcattgtaaagaaaatgcctctgccaccatcatcactatgctgaatttcttttgctctaaaacatgggaaatattgatttttttccctgtttggttgatgtggagaggtttgtcttctagaatccatgcccagtatttgagggattatggggatgattgttctgtaatggcattaaatgggaaagctaggggtaccagtgtgctaattgggtaacaactcagccagggattggataacaatgaaagcagagtagaaggggagggaaagctggggcttcttggaattttgtttgcttttgctttgtgaagagcagatgctatttgtatttaacaatttccttttctttgactaatcggcagtatcttgctggaattggactcagagttcgaggggccttttcaacatttcatttaatgccttcatatttcagatgaggaaaccgaagcctatgaggggtgttccttgtccaaggtcacagagccagttagtcacaaaatcagtactgaaaccaataatcggtcctactgtgcttcatgaaaacagtttctacccttcaggaactctctttgctgagactgtgatttttttttttttttttttctgttgagaatcactttcagcttgtgaaagaaagaaaagagttgttttttcttcaatgcatcttgccaagaatgcacgttcagtgtcagcctgaaggcagccaagcattttacagacctgcaggaatgaagtaggggaaggttcagggagtctgaagttacttctggagtttttctggttagcctttgcctagtaggagcttgataaaaatagaagatcaagagacagaccttctataatagatctttcccccaaatatgtgaaatctagagaatccatttatgaatgaggaagaagcaactctaatacaaattgagttgggttttaggatgtggatatataggtagatgtaggtataaactgccatttgcaaagctctttacagtataccaggcactttaacatacattctataactaaacagggaagaaatgtgttaaattacctccaatttatagatgaggaaactaagatttagagaacctaggtacttccctaagattgcatagctagtcagtagttgagccaagacttagattttctgtgtattctttccacggttccccattgtttttattccctttagtgatgaaagagaatataagtgctgtacagaagaatacatagttcagaaagtagaagtgtcaagaagacatctggggccttctgtagagaaacggaagtagccgtctgtacacatacccataggaagtggtggccattagaaaatgtttgaaagctggagaacagcattagagaagtgggtagctgacagggctgagacacctgagcttgtggtaagaatttctatgtgctattctgtgaaggctgctgaggaagacagtccagaccaaggtagatgtctttaaaggagaattgcctgaagccagtgaggtggttaaaaaaaattggggaagatgcatattggtgataaaggagggagtaaccttgggcatttttcattacgtctttagggtggaaaaaaactagaaaattataaagtagtggtggggcgtggtggctcacgtccataataccaggactttgggaggcccagatggggcagattgctggagctcagtagttcgagaccagcctggccaacatggtgaaatcctgcctgtacaaaaaatacaaaatttagccaagtatggtggcgctcacttgtaatctcaactactcaggaggctgaggtgggaggatggcttgagcccaggaggcagaggttgcagtgagccgtgatcacaccactgcactccagcctggttgacagagccagaccttgtctcaaaaaaaaaaaaaaaaaaaattgttaaggagttaagaaagaggaaaagtaggatggtattttatagactacttgcttttttattctagaagtttcatagatggtgcagacatcatttagcccaagttacctgtgaatgttgagtttggggatgattgttctgtaatggtactaaatggggaagtgcggggtgccagtgtgctaattgagtaacaacttagccaggaattggatggccacgctagcagagtagcagaggagagaaaggccataatcccagcactttgggaggccgaggcgggcagatcacttgaggtcaggagttcaagaccagcctggccaacatggtgaaacccctgtctctactaaaaatacaaaaaaaaaattagctgggcatggtggcaggcacctgtaatcccagctacttcgaaggctgaggcaggagaatcgcttgaacccgggaggcggaggttgcagtgagccgagatcgcaccactgcactctagcctgggtgacagagaaaaactccatctcaaaaaaacaaacaaacaacaacaacaaaaaatttaaaaaaaaagaagtggagggaaagctggggcttctatcttgcttggaaccagtttcatccttaaatggagttgtgtgtttgtagtgataccacacataatacttcgtaaaaataatcacagtataatttccttcttagtatttttcagttcaacaagtttcacctatgatctcgatttgatctttacaacaaccctttgaactaatcaggcagggcattattagtgctctcagacaggtgaagtcaccaagggcagataatggtcccttgttttacagatgaggaaatttaaattcagagaagttatttgctcaaaattgttccactagtgtgtggcaagttgggattcaaacccagatcttctggctcctagaggtggaaaattttttactatattatgatgtattatagaaggaggtcaatggttatgccttgtagggtgcgtttgggaagtctgcgtctctgggccttcctgtatggtgtcttgccattgtagttacctgattctccctgatgtctgtcccagctggcctggctttgcactcagccctctcctgctccttgagcctctcctcctaataccatctttgcacacagctcagtctctgtaaaaccctgtcatgtatcctcctcggggttgcctgtgtctgccagtatctccttttccctctaggacctgaggaagccctcttagagaccttgccttattgtgcattgttttgaaaattgccctcctagccagccatccctgctctaatgattcaccttcaaactgtgatttcaagtcttttggatcttcttatgccatgtgttaggcagcctctgacattcagaggggctcataaatataggtatgctatggtagtatatttaggaccagttcttttgcctccttcttacccatatgcctttaatcagcttctgctcctctggcaatatgggcataattggcatgtgttttcagcagagctcattatagagatttccattgcagcaggcaattttgtacaagcccctgtctgacattattaccaaagctattgccgttgttttgtcaggtctaacaagtccagcaaggtctggctgattgaagcattcattgaattggccactgggcaaggaggcggttgcttggcagttcttctcttcagggagggtttccttttttagtagcagtcttacctctaaggagtcagcagctccctttagaactggctttcccaaagtgtgtttccccacccttccacccagtggcttccagttgttctgaaagctgctggtcaactgtgcctttaatatttctaatggcaggagttaataatgtgatgtttaatagaaaacatgtgtcatcctattggcacaccagagaaggcagctctggtctctccattaaaccagcaaagatttttgttttttaatggtgataagtagaaataagtatatgggatacccacaggtatcttttactttgaagtcttttgtagcttctgcttttgagaataactgatagagggaaacttcttagccttgcacctttgctttttgctcctttccagaagtcctgggcagaagagagaggggataaggaatagtcacttgaggttgggcgtggtggctcacgcctataatctcagcactttgggaggccaaatgggtggatcacctgaggtcaggagttccagacaagcctgggctacatggcaaaactccgtatctactaaaaatacaaaaattagctgggtgtggtggcatgcacctgtaatcccagctatttgggaggctgaggcagagttgcttgaaccccagaggtggaagttgcagtgagccgagatcgcgccactgcattgcagccttcatgacagagtaagtctccatctcaaaataaataaataaataaataaataaataaataaatataaaaaggaatagtaactcgatttctcaaggagatctatttgtagtaaagcaggagccagcatgctgtggctcatggccaaatcctgtccacctcctcttttcgtaaataatgtctgttttcataaataacgttttattggcacatagccacacctatttgtttatatattgtctgtgactgcttttgcaataaagtggcagaattgagtcattgcaatagatacagaatagccctccaagactaaaacaggctgtgcaacattaattggctgttgttgggtggggcagggcattgagttccttaagtgttccttggaccttcttgtttgtgtccagcttctgctgagtttgtgtagagaggtatgcagggaagtggttttggaaatgacctattcccgcatacataatgaaagcttggaatgcaggttgtgctatgaggtgttttcctgtttgaatgggcaaagtgttcatcatcagagatgtattcctattgcctaccccggggcctgacacagtctcagttctgatctcaagaaactctcatacaggggttttgcttttcccagtgggcattcagaaacacactggttcactagcgcagaaacagttcatcctttttgactgtctgtctttgtgtatttggtcacgaactcctttttcctctttcccattatagatagtcgatgggatttttcacaaagcccttgaatagtttgtatgtgtttgttgattttgaactttgaactggtatatatataataccagcactttgggaggcccaggtggggcagattgcttgagttcagtagttcgagaccagctaggccaacatggtgaaatcctgcctgtacaaaaaaatgcaaaaattagccaagcatggtgatggtcgcctgtaatcccactactcaggaggctgaggtgggaggatggcttgagcccagaaggcagaagtttcagtgagcgctctctctctctctctctctctctctctctctctctctctctctatatatatatatatatatatatatatatatatattatataattttttttttttgagacggagtcttgctctgtcacccaggctggagtgcagtggcacgatctcagctcattgcaacctccacctcctgggttcgagcaatactcctgcctcagcctcccgagtcgctgggactacaggtattcaccattacacctggctaatttttgtatttttagtagagatggggtttcaccatgttggccaggctgatttcaaactcctggccccaggtgatctgcctgcggtggcctcccaaagtgttgggattacaggcatgggccaccacacccagccttgaactggtatattaagccctaaagtgtattatacaattgggtaatatataagcagtctgaagctccgttggcagagaaacccatggtttttgatatgttatttgtcataagctaacagggacctttttctctctttgacacagttgggaagttctttattaaaggggccagacagcagttccctttatagttaataatgatgtaatacaccaagtagtgaaggctacaggacaggagccacagaagtcaccacagggcacattgcccagtcaagctttctccagctggtcagataatatttcactgaggtctaaagagaagaaatgttatgaacaggagcaactctctgcttccctgactcttaattccttctgattgattggtatgatcttgttatttcaggatgattattttagtatgatttaatacagatttaaaaaatatggcagttataagtttctatctcatgttattcatggtaccttttcaaaatggagcaatctggcctccaaaatctagctatagagaataatcacaggttcccatgtgtaagtagggcaaagagaatcagaattacaatattagaaagagtcttgagaggtcatggagtcaactcctctgcttcctagccacctaaatcagccaagacagacgtggctagagaaagaatggaattagattgttgccttgtagatgtcttccatctttaactctgtccttttgagagcagtagaaactagtttggaaggggaaatgctaacttttggactgcagggctttaattaagtcttcttctttttttattcttatgcacctaaagaacatttgggactaaagtggttaaagacatagtcttggttgaagttaggttactgagcttaggtttcagcatattctctgtctaggaaattgagctcatcagcaagtaatggtaatgggaaggcttagcacaatggcatttagttgccagaatgaccattggcttgggaggcacacagatctgggtttgaattccctatttactatctgggtggcatttgaacaagctatgaacttcttaaagtttcagtttcctcaattataaatggagacagtaataccaaccttggttatagaaggtatacatgaaataacatatttgaaagtaatatactcttaataaatgttagtctctactgtttaagtatatattttaaaaaaacatacttatgacagtgcttgtgccataaacaaacttaaattgtagtaattaataacttaattggtgtttggatatggcttatgacttgaaaattcaagaatatacttcacaaagagaagagaaaaggaatatgagtgcatatttctcatagtcacacagccttacccatattccaatgacagtaaagtggggactgatcagaaagccttctgggatagcatataacagcagccacactcaccaataaggtattggtatgcctgatcctctcctccttttcagtaataaccatttgagaaagattagcattgttatttatagtgctcttgggtctgatgttatatcattgtggttctactggcactgagaaagggaacaatctttagttctggtcaacgtgcctaacataactcctggccctcagtagtctctaagtattttatttgaatgaattaataagaccctattttacaggagataaattgagacagaacggttaagtggctcatctaaggattaagagagacagagttcttgtcaataatgggacctggtctactgccttggttcttaacacatattcttccctttccaggctgtcttatcccatgaatattgtgtaatacactgtaaagagacttccttcccccttatgagctggtgatttgcttgtacctaaattaagagagtaggttaaagatgcaatgagagtgctttatggcaattcaaagtataatgttttctctaggatttctttcattttgtttgtttgtttgttgtttttttgtagagatgggggtctcattatattgctcaggctagtcttgaactcctgggctcaagtgatcctcctgccttggcttcccaaagtgctgggattacaggtatgagccactgaacctgccctatctaggatttcttagtttttggaattgcaacagagagggataaccccttttttgcatgttttgtcagagctgaggttgaacaaagggccctgggtgggcgtgtggggaaggataggtggttacggcatggattttataggcagatggtgttggcttggaagaaaatcacagtaacagtaacatgtgggtgtgggtgtagagggatatcttcttttccagcactgtatctttgaatctgcccaccttcccctgagaattggctttgattaccttgatgttggttattctgatagacgaagctgcagggcagggctaatgtacattaatggagatgtgtgtataaatcatctcacagaatatacagacatcctctgtctctagaaagttggcctctttttgaacttctcactatgtcctagttgttacagaagtaatttagaaaccccagaagaaatatataaatagggtctattgcatactgggcctgaacaagctggagaggaataatttcacatttgatggcaggctattttacttgtttgtctttcttctccctttgcttcctgccttgctttgagtgactgcagaagctttttgtgattgtagggagccttggccaatgtgggaataggacccaggaattcaaatttctcacctgacatctgcagtaccttcagaatgcttctgaaactgatataaatgaagaaatactccaaaagattactattgaacaacaaaataaaaactttcacatgataaaccatatttagtcgcattcttcccttttcaggccccaagtatatagctgagatgggtctagtgtctttctttttatgtaccattttaggcaagttcttctcagtttataaatagacttttcattctcaacccttcttatgtgggcaagaaaaaggatttgtttaatagagtctgataaataatttttaattgttttaaattgtgataaaatatacataacataaaggtaccatcttaatcatttttaagtctttggttcagtgggattaagtacattcatattgttgtataaccatcaccaccacccatctccagaactcttatcgtcttgtaaaattaaaactatacacgttaaactttaactccccattcccagctgccctcagcccctggcatccattgttctactttctgtctttatgaatttgactactctataaatggaagtacctcatgtaaaggaaagtatacagtttttggctggcctgctgtgactggtttatttcacttagcataatgttcttaaggttcatctgaaggaaacaaaaatatttcacctgaaaatatacgtctttgtcatattttaagatgactgttcagagcaccagtaaacagaagtagccctgcaaagctgtctttttggggacatttgcagctgtagggaaaatctgcactgatatagccaggtttttttctgaggccctcccttgtccagatctaggaaagattaactgagagtctgacacctataaaggtctgaataaacattcaccatctattctctctgagggctctgcctgtgaagttttatctatataacaagaccacttctgctagccaggcctcctcttctccccctgttctgccaccataacctgattttccaccataacctgtttttggccatgcctcgagggagtttccattctttctgtaacctcaagatggtataaaagcgtcaaccctatacaaactctggaagaaaatctcggaaaataccattatggacataggaacaggcatagatttcatgacaaagacaccaaaagcaattgcaataaaacaaaaaaattgacaaatgggacctaattaggctaaagagcttctgtgcagcaaataaaactatcaacacagtaaacagaccagctacagaatgggagaatatatttgcaaactacacatccaacaaaggtctaatatccagaatctatatggaagttaaacaaattaacaagcaggaaacagacagcctcattaataagtgtataaaggacacgactgacacttttcaaaagaagacatatacggggccaacaagcctatgaaaaaatgctcagcatcgctgattattagagaaatgtaaaccaaaaccacagtgagataccatttcaccccagtcagaatggctattattaaaaagtcaaaaaataacagatgctggcaaggttgtggagaaaagggatcacttatacagtggttcagccacttcggaaagcagtttggagatttctcaaagaacttagaacagaactaccaccattcgacccaacaatcccattattgggaaattattgggtgagggttgaaaaactacctattgtactatgcttattacgtgggtgacaaaataatctgtacaccaaacccccgtgacatgcaatttaactatataataaacctgcacttgtatgcctgaacctaaaataaaagttaaaaaaataaaagcaccagctaccttgcctttctttgaattcttatattttgtatgattcctgtgcacattaataaattgtatgccttttctcctattaatttgccttttgtcagttgatttttcagagaaccagcaaggatggagggagttttcccttagccctgatacatccatcttgtaacatgtgtcagaatttcatttctttttacggctgaaataatattacattatgtgcatatacattttgtttatccattcacctattgatggacacttaggttgcttccactttttggctattgtgaacaatgccgctgtgaatatgagtgtacaaatacctctttgagaccttggctttcaactcttttgggtatataccctgctatggtgcgaatgtgtatccccaaatgcatgtattggaaacttaatccccaatgcaacagtattaggaagtgtagacttttgggagatgtttagtaatgaggcccctgagatgtttagtaatgaggcccctgttattatcagtggattaatacccttataaaagggtttgatggaagaagtttgttcttccactttttttttttttggtggagtctcagtctgtcatccagggtggagtgcagtggcgctatcttggctcactgcaacctccgtctcctgggttcaagcgattctcctgccgtagtctcctgagtagctgggattacaggcgtgaaccactgcactggccttttttgttgttgtttttttgctcttcggccttctgccatgtgagaacacggcattcctcccctatggaggcagtgccatcttggaagcagagcctggaccatcaccagacacctaatttaccggcaccttggtcttatatttcccagcctccagaactgtgagaaataaatttctgttctttataaattactcagtctgtggtaatttgttatagcatcagaaatggactgagatatatccagtagtgtaattgctgtatcatatagtaattctatttttaattttttgaataacttgataaataattttaaagttttcttcaggatccataatatttgcatgaactgactcataaaaatgttggatttgctactttgattcaaacccatgattcattcggccaggggttttgttttggacagtggcattaggagatagttgatgaaaagaatgatattgcttcacacagtgattagataccctggaagtccgaatttctctacatcttgacctcatattaatttttctaactccttcttaaacctgtttataactctaacccacataaaggagtttcctaagtctactcatgaaaatatgacgttatttgatttgtcctagaagtgattctttgaaacttcaagaggaatttccaagttctggttttttagacttgcttaaaaaagaaaagtgtattcacatatccttaccttgtgtgattttaaagatttgtattttcagccctcagccctcagccctcattcctcatctttgcatacaaaagaattgtattttttctgttagcaacctcacttaaaaacacatcccttgcttggtgagtttcttgtcctctttctggatcatctccagctgtcttatgacattctgaacattgtcctcagcattctagggcattgctgaagcctataaaagagattttggtctgcaaagtttataatcccctgcctagtgataatcaccttattgttgggcctgggttttttggagacagttcacaactcctcctctccaggactgtagccaataaaatgttctccagagatagggtactgacagatgctcctgtgtgttcatgagagtcagtgtggcccagcagaaagcactggcctagggtttatagaattaggattctagtcttaaatctttgctaaccacgcaatcttaggtacagttcaccttttggtgcctcaatttccctatatgtgaaatgggatcaagaacacctaccctgttcccctcacaagattattctgagaatcaagtgagatcatggaaatgaaagttctttctaattaagtgctgtatgcctagaggaaatgtcgattgagacttaaagactatagggtgtatcaagtaattttgcttttctggcttaatttttttatttataagcccatggattagttgctaattattattattatctttttttgagacggagtctcgctctgtttcccaggctggagtgcagtagcacgatcttggctcactgcagcctccgcttcccgagttcaagtgattctgctgcctcagcctcctgagtagctaggattacaggcacacaccaccacgcctggccaatttttgtatttttagtagagacaaggttcgccctgttggccaggctggtctcgaattccttgcctcaagtgatctgcccacctcggcctcccgaagtgctgggattagaggcatgagccactgtgtctggcccagttgctaagtagaataagtgatttaacatgcacatcagttagaatattgtcactgctgttacctcattatgttaatactactggacatttgaaggtcagatttctaataatctcaatatccagaataaagctgggagtctagaggcttgcctttccaaaaacggtctctaatagcttaagtggttttcgctgtgcactattccgtgggagagaatgttgtcctgattttattggctcttcatttaaattctgatgtggtttctaccccttagaaatttagaagcagaatctagggatttggaggtgaagtgaggagtctagcaccagaactttgatatgaaaaagaagtgacaatggaattgaattgaagtgtgtgtatgtattgggggagcctgaaaatattggggaaaacagatataaggcctataaagcattgtgctttgtgtctattttatgtagagttcaatagtcctacatacctgagcattctttgagtatgtgacagcctcagattgactgatgttgtcacaatgatgaagtggagtcatccaaaaaccatttaagaaagcagaaagctgggcatgatggcatatgcctgtagtcctagctgctcaggaggctgaggcaggagggttgcttacgtccaggagttcgagtccagcctgggtagcatagtgagaccttgtctctaaacaacaccaccaccaacaacaaaaagaatgcagaaaattaaatgttagcttagctttccattaaaatggttaaattacaaaagttctaaatgtttgaagggataaactttatttaaattgaaaattaactttttgtaatggattattatctgataatgctgaataaacagaacattattgtattaatattttgaccattatattacaaaggtatttttgttattttctccatttggataattttgtattgttatacctaatttatagtagaggacattgacaaggtatggttatgccaaatttatggcatcatttggagaggaatacatggttcttatttattctgatatgttaccatgctataaattgtataaggttttcctataggcattgtttcattttacctccataatgatccattgaggtacatatcgatgcccgcattttacagatgggaatactgaggcttaagataggatcaacatattcataaaagtggtagagcaatggatttaaatgttggccttttgactctaaagctgttgttttttctaagtcttccacttaggtatcatcattatgccttgtgttttggaacaattctgtaaaaaagaacatataggcatcattatccctattttaccatatgagcaaattgagctgaaagataccaagtgagctgcccaatggacacatgatggctagaacccaggtctgtcgatttctggaccattaactactttattttatgtatgtatgtatttatttatttatttattttgagacgaagttttgttcttgttgcccaagctggagtgcagtggcatgatctgggctcactgcaacctccgcctcccaggtgcaagtgattctcctgcctcagcctcctgagtagatgagattacaggtgcacaccactacgcccggctaatttttgtatttttagtagagaccgggtttcaccatgttggtcaggctggtcttgaactcctgacctcaggtgattcactcgccttgtcctcccaaagtgctgggattacaggcatgagccaccatgcctggccccagtatctattttagaaaccattttattttgaaataatttcaaagttacagggaagttacaaaaatagtacaaagaacctcagtttatccttcagtcagattcactgatttttaaaaaatattttgctctatttgtcttattctgtctctgattatttacatattattttttctggatcattttagattcagttgcatatattacgaccttttcccttaaatccttcagcatgtatttcccaagaataaggatatttattacatatgcatagtagaagtattaatgtcaggaatttaattttttttttggagatggagtcttactctgttgcacaggctggagcgcagtggtgtgatcttggctcactgcaacctccacctcccgggttcaagtgattctcctgcttcagcctcctgagtagctgggattacaggtgcccgccactatgcccagctaatttttgtatttttgatagaaatggggttccaccatgttggccaggctggtctcgaactcctgacctcaggcgatctgcccacctcggcctcccaaagtgctgggattacaggcgtgagccaccgtgcctggcctcaaagtcaggaaatttaacactgatataatactattatctaatctaaagtcaatactaaaatttaactaattgtcccaataatatcctttttgtcccaataatatctgttttattttctgacccagaaaacaggattatgagttgcatgtagttatcactggagtattgccttttttttttttgacagattcttgctctgtcacccgggctggagttcagtggcgtgatctcagcttactgcagcctctgcctcctgggttcacgcgattcttgtgcctcagcctcctgagtagcttactagattacaggcatgtgccaccacgcctggctatttttttgtattttagtagagatggggtttttaccatgttggccaggctggtcttgaactcctggcctcaagtgatccacctgccccagcctccctaagtgttgagattataggtgtgcgccactacgcccagcctcattgccctttatataatatcttgttgcttctcttagcccattatgtcccaaaagtttagaaaacatttcttggatgaaagaagtgcataaaatagaggttaaaaaatgggaatgtggaccctttccttttcagtcacctcaggttgcttgcatttttttgtgaaaactcatctaccacttagacctgataaagatcacttattctgcagcagcttctgcttccaacagagtggggatttgggcccctccaagcttttctgctgacatctaggaaatcccaggtgtacacaggtctgatctgagctgtaatgcaggagtgtggctgtgccaagctagggaagaaagaaaatcaccccaaagactataatgggccaggcatggtagctcatgtctgtaatcacaacacattaggaggccaaggcaggaggatcacttgagcccagaagtttgagaccagcctgggcagcatagtgagacctccgctctaaaaaatttttttaaaattagccaggtggtgtcatgtgctcgtatgggaggctgaggcaggaggctcacttgagcccaggtgtttgaagctatagtgagctataatcacaccacttcattccagcctgggcaacagagtgactcaaacaaacaaacaaacagactgtaatgagcagactaggggaatagatggaagagcaaatgctgtacctgatgtaggacattattatttcaaatgtgcatcacttttatgataatgtttgcatcacatacgaattctttttttaaaattgtggtgaaaaaacacataacattaaatttaccatctgaaccatttttaaatgtacagttcagtagtgttaagtagatttacattgttgtgcaacagatcactagcttgttttcatcttgcaacaatgaacctctatacccactaaatgctaattcccccttctccccccagccttggcaactacctttctacttcctttttctatgattttaacaacttttgttacttcatattggtggaatcatacagtatttgtcttttgtgactggcttattttgcttgacattctcagagttctttcacgtagcatgtgtcagaacttcttttctttctttttttggtttattcttttttaagtttctattctcctacccgaatgtgtcagaatttcattcctttttaaggctgcataattattcctttgtatgtatatataccgcattttgtttatccttttacccatcaatgaacatttgggttgtttccaactcttggctattgtgaataatcctgcagagtacataagtgtgcaaatacacctttgagatcctgctttgaattcctttgggtatgtacccagaagtgggattgctggattatatgataattctatttaaaagttttggccaggcgcagtggctcacacctgtaatcccagcactttgggaggccaaggcaggcagatcatgaggtcaagagatggagaccatcctggccaacatggtgaaaccctgtctttactaaaaatacaaaaattagctgggtgtggtggtgcatacctgtaatcccatctactcgggaggctgaggcaggagaatcgcttgaacctgggaggcggaggtcgcagtgaaccgagatcatgccactgcactccagactggcgacagagtgagactctgtctcaaaaaaaaaaaaaagtttttaggaaccaccatactgttttccataatggctgcaccattttggcatcccataccaattctctgaaataggtagagttgttatcattaagcctattgtgcagataaagaagctgaatgacttacatatatacaaagttacgcagcggtaatgtaaaactgagacttcaacccaggtctcctggctctgcattcagcatctcatttcctcttatcttactcttctgcttgtgccacccctccagcgctcctcagacatgactgtggcacttcacttttagcatttttctgagtctagatggtacaactgtttcctttgctcaagaaatgccctccccatcaagcagtacatctcgtgcagtacctgagttcagaatgctgcctctgtttagactcaccattgcccttttgccttgttctcttgagcctaggatcgtacacaaggcacatttgaggaagcagccaattggcacggctctgtgagtctctacagcagtaggtctatgatagggacgtttattttttaaagtcgaaaggcacaattgctctttgatttagttgctgaacactgaccccctgcttagatttctgcaaattgaaagcagctatcatttcaacatcaacaccttcaaaaagaaaacacgcttgcacatgctcaaaaaattgctgatctgtagggaagagtagcaattccaaaaaagaaggcatatgatttttatctttcagtagtaattaacactacccttctctctaggaaagcttcctgccaggagttgtgtctcctctctgagtttaaacttatttgctgcctttttccttcctagagatcatctcaatattctattccacttaaaggcatttgacaccggttctgtatctgggctctgaggctaatggtatgaaagcttccaagacaaactcccaaaactgtagattcctgaatcaagtgtcttgctggagtctgtagacttgaaacatttggcagctgtgctgcttttcctatttaacacacagggacatttggcggctaggactgtatcttaattctccatctttggctttgctttcttcatcatcttcccatctcacccatttctgatttgtgcagtgttggcttgttcaaattctgatcttttaggacactgtcattctttctaggcaggctatcaaaatgttcagtctttacttcagatactcctgtacacctcagattacacctctctgtgaaaacctctcccccaattttatcttttaacgtgtgagtatgtgcctatgtttgtttttctcggagagaaagatggtatctccctagagtttagttgactcccaaagtttaaaaactactggccatatgtggaacctgtcttggccctttccattatcacaatgcctcaagtcatttgcaaacctgacctgataagcactcttctgaagattttatcaggacctatttctttggtttctggttcttgatatggcactacctataactctaactgggctgtttgaagagaacagatcatgaggcccatcaacataagatatgcaataagatttctttatacttggggtttaatgattcagttcatactgacattaggcattatttactttgcctttgctttgagtcaaaatccggctaagcattttccccacatcctactgacttctttattttggttcatggtatttgtagcctaccagttggcaagaatggaaacctcaaagacaggctcttctcttttcttctcttccttctcttctcttctcttctttctctcttcttcttcttcttctccttctccttctcctccttcttcttctttttcttcttccttctctttctttctctcttttcttttcttttctttctcccttctttcttctccccttctttctttctttcctctctcatgacccttacatccaataaatgcctaagtctggtagatttacctccagcagtgtcttttgcattcgtctccacctttctcttgctccttcttactgctacatttcaaacacttttcactttttgcctgagaaaacactagccgccaacttctatccctttctccttcggttcattccatactgattccagatgaactgtttgaaactaaagcactcatcatgccacttcctgttcagaaaccttcagtggttttccacactgccggcttcctcaagaaaagagtgtgcagcctgaccttcaaggttttccagattatgggcctaagggtcttccagcatcatctcctcttacttccctttatatctttggctatcaagctaaattggactctgcactgttctgcaaacctgtgttcagctctggttctcctcggtctcttttgctcaggccattcttttttcctggaatgctcttacccccatacatctctgtttattgaagtctgcccatcatgcaaggcccatctcaaatcttaccttttccttgcattcttcctagatctccccaaccgaatatgatttcttcctcatttgaactctcttgggacaatctacatctcctgatgtttgtataatgcttggtattatgcactcatcttcactactacattggatgctcttggaagataaaagttgtctcttagtagtcttgtatcactgtacaattgtgttactgtacaattgcgttactgtacaattgtgttacggtacaatttgaaacttagggccttgtgtgtatcaggcttttagaaagtatttgtggaattgagtagagttttatttagctttctttgtaatcctggtagtctatctagaatctttctagagcgggccaaatgccaccacctttgaggatatcttctcagttagaattaaccctttgttccttgatgttcacttacatgttgtttacactgtacttgtagctgtctgtctcattactaagttagctgtattgtgaatatctcccttccttctttggagagggattggttctgatttattactgtatatctaatatggtttggatttgtgtcctcacccaaatcccatgttgaattgtaatccccaatgttgaaggtggtgcctggtgggaagtgaaaggatcatggtggcagtttcttgtggtttaacaccatcctccttggtgctgtcgtcatgatagtgagctcttgtgagagctgattttttaaaagtgtgtggcacttccccacctcttcttgcccctgctctggccatgtaggatgtgcctgaaagaaaaaataacaacaacaaaagacatgcctggccaggtgcagtggctcacacttgtaataccagcactttaggaggcagaggcgggtgaatcatctgaggttgggagttcgagaccagcctggccaacatggcgaaaccctgtctttactaaaaatagaaaaatcagccaggcatggtggtgcacgcctgtaatcccagccactcaggggactgaggcaggagaattgcttgagcccaggagtcggaggttgcagtgagccgagatcatgccacagcactccagcctgggcaacagagcgagactccatctcaaaaaaaaaagaaaaaagaaaaaagaaaaaaaagagagaagaaagacgtgcctgcttccccttcgcttttccccatgattgtaagtttcctgaggcctccttagaagcagaagccactatgcttcctgtacagcctgcagaactgtgagccaattaaacctgttttctttatacattactcagtctcaggcattttttttatagcagtgtgagaacagactaatacaatatctcatgctgattagcacagtacctggctcataatatcaccggtagagggttgtgactgcaagttgtccaggttcttggcgttttggacaaagaattggacaaaacgccctgcaaagcaaagaaagaatgaagcaacaaaagaacgaaacagggatttattgaaaacaaaaatatactccacagtgtggaagcagacccaagcagtggctcaagggcccagatacagaatcttcttggattcaaataccccctagaagtttcccattggccatttcatgctcacctcatgtaaatgaagtggtagcccagagtcagtctgattggttgcagaaagcagtcgaccagaggctgaagtgaagttacaaagctcacactcctctgcaaacatcctattggttacagaaagcaaccaatcagagcctgtaatcccagctactcagaaggctgaggcgggagaattgcttggacccgggaggcagaggttgcattgagccaagatagtgccattgtgctccagcctaggcaatgagagcgaaactctgtcttaaaaaaaaaaaaagaaagaaaaaaaaagaaactaaaacaagaccaatgtagttggaaggtatggagtagttgcccaatcactcagggcctataggtcatgctagggagatatagcgtgaacccctcagagggttttatttatttatttatttatttatttttatttatttattttgagacagagtcttgctttgtcgcccaggctggggtgcagtggcacgatctcggctcactgcaacctctacctcctgggttcaagcatttctcctgtctcagcctcctgagtagctgcgattacaggcatgtgccaccacgcccagctaatttttatttatttatttattttgtaattttagtagagacggggtttcgccatgttggccaggctggtcttgaactcctgacctcaagtgatccgcccacctcagcctcccaaagtgctgggattacaggcatgagctactgtccagcccctcagatggttttaaataggaagattcaagtgatgtgctttatattttgagcttactctggctgcacagtggagaatgaattcaagacaggcaagaatgggtgaagggagaccggttaggtggtagttgcagtggtataggtggaagaagttgatggcttggatgagggtggagatggagagaactgtattaatgggatatttaggagtttacataaatcggacttggtgataaattggatatggaaggttggggagatggagatatcaaagatggctcactggtttgtaaatagatggtggggccattctttgaaatggttaattctggagaggaccagttttgtggagaaggtttggcatattattactatacacacacacacacacacacacacacacacacacactttttttgttttgagacagagtcttgcactgtcacctaggctggagtgcagtggcacaatctcagctcactgcaaactctgcctcctgggttcaagtgattcccgtgcctcagcctcctgagtagcttggattacaggcgcccaccactacgcctggctaatttttgtagttttagtagagacagggtttcgtcatattggccaggctggtctcgaactcctgacctcaggtgatccgcccaccacggcctcccaaagtgctgggattacaggcgtgagtcactgggcctggccagattttgtatatatttaggaccctccctgattcccagtctaaggtagcacattgcctttaagttagggccttagctgtctgatattgtgtaaatgtgatcctaattcaagacaggcggaccagagcaagtgacttctttataaacctgatagccctgtgtttctgtgtggtttcttttccaccattaaatgcatcatcaccacagcagtggaatacatagaaggggttggagaacatttcgtgggtttaaaaatttcaagtgaaaaatatgttggattgaaatctttggaaactattccactgggctattatagttgcagctgaaaacaattaatggagcagcagatgaaaaaccaaaacatgcaagcattggggcactgtggaataaggggatcatttaggtgggcctttctaccattggatagggcataaattgagaaaagtgcacatgtagtcatgagcaagtattaaagtgtctccccaaaatactagcaaatagtgagctaataaatggaggtggagaaaaataaaaggcaagggacaatataagatcaaagacagcttctgtttctttgcagcattttgtgcccccactctggcaggttttctacagatgctctgatcaggaaccagctggccccagggctggctctcagtctctcctggcagtccccacaccccaagcaagatcattaaatcatccttttgttaagggacgatgggaggagcctaatctgagaaaaagaaaagtaaggaagaacagggttacacctgccagtgataaaaggaagactgtggcaataagggaaaaaagcccagggaattaagaaagggttaacctgtggccaggcacagtggctcatgcctataatcccagcactttgggaggccgaggtgggtggatcacttgcggtcaggggttcgagatcaacctggccaacgtggtgaaaccctgtccctactaaaaatacaaaaattagctgggcgtggtggtgggtgcctgtaatcccagctacttcggaggctgaggcaggagaatcacttgaacctgggaggtggaggttgcagtgagccgagattgtgccactgcactccaactggggcaacagagtgagactctgtttcaaaaaaaaaaaaaaaataaataaataaataaaagaaaaaagtgtcaacctaacataacagaccaaaaaaaaaaaaaaaaagaacataaaagacaaacagaaacaggctgtcaggattcaggatgtgataaggctgcagtatggaaatggattcagctacctgggaaacttgcagagttgcaattgaaaaagttaatgatgttctccgataagaagcctggggcactgagaaggcctgttttgtaactctgggaatcctttagccagccactgtggtccctggtttatagccaattagaagttagaaagaaaaatggaaaaaacaaccaaaggaaaaagttgttaacagctgctatgattttatctaaatagaacttccattacaggctgtgagaagattaaagaaatctgggtgaactgtgctggagggtggagggtgttccagcacagctcttgctgagcagtcctggtgttgctccaaggcaagagcagcttgcaatcaggaggcagttttcgctagccacccagagaagattaacctcaagacccaggtaattgcagtttctgtttgctcctcagtcctgagagagtcctatgcccctggggggaagctcccctgggatgggagaggagtaacgggtaaatttccagccacttactacttatcaagggctcatcctgtgacagcaggatactcattagtttttatttttatttttatttttttgagatggagtctcgctctgtcgcccaggctggagtgcagtggcgtgatctcggctcactggagcctccgcctccagtgctccagcgattctcctgcctcagcctcccgggtagctgggattacaggcacgtaccaccatgcccggctaatttttgtatttttaggagagatggggtttcaccatgttggccaggctggtctcaaactcctgacctcaggtgatccgcctgcctcggcctcccaaagtactgggattacaggcgtgagccacagcgcctggccaactcattcgtattcagagtcaaggactccctgattgtccctcatacaagttctcttgccctaaacacagggagagacatgtagattcacctagcctccacaaccttgttttttttttttttttttttttttttgagagcagtggcacaatcatagctcactgcagcctccaactcctgggctcaagcgaccctcccacatcagccttccaagtagctgggaccacaggcgtgtgccaccgtgccaggctattttttttttttttgtagagacagcctcactatgtttcccaggctcatctcaaactcctgggctcaagtggtccttccacctcagcctctcaaagtgctgggattacaggcatgagtcgccattcctcgtccacagccttgatccttactggctatacaaggaagtcctgctttgttctgtttcaggaaggaatgcttgagggtcccaccagccagcctccaccgccagtaatctattgctctgaatcccggatataccttcaaatagggagcttagattccttaggcatcctgaaatcaattgccttaatataaacaagtaacaatcagaatatataatggaaggaaagattccactttaataagaacagaaaagagaaaatacttaaacttaatggctgggcgtggtgactcatgcctataatcctagcactttgggtggccgaggtaagaggatcgcttgagcccaggagtttgtgaccatcctggacaacatagtaagacctcatttctacaaaaaaatgagaaaattagcagctgggcatggtggctcacgcctgtaatcccagcactttgggaggccgaggtgggtggatcacctgaagtcgggagttcgagaacagcctgaccaacatggagaaaccccatttctactaaaaatacaaaattagccaggtgtggtggtgcatgcctgtaatcccagctacttgggaggctgaggcaggagaatcgcttgaacctgggaggcagaggttgcagtgagccgagatcgtgccattgcactctagcctgggtgataagagtgaaactccatctccagaaaaaaaaaaaaagagagagagaaaattagctgggcatggtgttgtgtgcctgtagtctcagctagtcggatggtgggggcaggaggattgcttgagctcaggagttggagattgcagcaagttaagattgcaccactgtactccagcccgagtgacagaacaagaccctttctcaaacaaaacaaaacaaaaacaaaaaaacaaggccaagcacagtggctcatgcctgtaatcccagcactttgggaggccgaggtgggtggattgcttgaggtccggagtttgagacgagcctggccaacatggtgaaaccccatctctaccaaaaatacaaaaaattagcggggtgtggtggtgcatgcctgtaatcccagctactcaggaggctgaggcatgagaatcgcttgagtctgggaggcggaggttgcggtgggctgagatcacgccactgtactccagcctgggcaacagagcaagactctgtctcaataaataaataaattaataaatacataggccaggtgtggtggctcacgcctgtaatcccagcactttgggaggccgaggtgagtggatcacttgaggtcaggagttgagacaagcttgggcaagatggtgaaaccccgtctctactaaaaatacaaaaattagctgggcgtggtagcgcgtgcctgtagtcccagctacttgggagggtgaggcaggtaaatcacttgaacctggcaggcagaggttgcagtgagccgagaatgtgccactgcattctagcctgggcaacagaatgagactcagtctcaagaaaacaaaaaacaaaaaaaacttaacatgtaaattctacatgaagaaaaaatattacatagtaacataaaagacttagactcaggtattcttgaatagaaagataataacataaaaatattaacttgcctaagtaaatttattaaaataaactcagtgcaaataaagatacaattttttgttaactagataaactgattctaaaagttgtatgtaaaagcaggcaagcatgaaaacccagagaaattagtcaatggagagtaattaggggaaattaatcttatcagatattaaaatatagcatgctattaagctatagtagttaaagcagtgtggtactgatgcatgattctaaaaacaacagaacagaccagaaagtctagaaatagattgaactcagaaatttcatgtctgataaaggtggcatttcagagcagtggggaaatgacgtattatttaacaaagtcaggccgggcgcggtggctcacgcctgtaatcccagcactttgggaggccgaggcgggcggatcacgaggtcaggagatcgagaccatcctggcgaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaacaaagtctattggatcaccttgatagccatttcggaaaaaagagattagtatccatacctcatgcttgacacccaggtacatttcagatagatcaaagatttacatgtgaaaaatagggccataaaacttctggtaaaaaagggagtatgtaaaaattaattttagagtgcagaagccttacttatatgatacaaaattaggaagtaaacttgaaaaatagaaataaaaaagggacatttaaagtataattgaaaaaaacagaaaggaaaggatgatatgtttgacgcatgaaactccaatttgtatatggaaaaagtatcatgaataaatgcaaatgtcaaattggtagccctcatgcattgctgcagtagaaattgacagaatctctttcaagggagtttggcaatttcaatcaaaatttaaaatgttagctgggtgtggtggtgtgtgcctgtggtcccagctacttgagagcctgaggcaggaggattgcctgcacctgggagtttgagggtgcactgagctgtgatcgagcctctgcactccagcctgagtgaaagagtgatactttgtctaaaaacaaacaaacaaaatcactgtttttttgtttgttttgttttgttttttaaagaggcagtgttgcccagactggagtgcagttgaaacgggagagttccctgaccccacttgcaggacatgcaacagaggtgtggctcatctgttcagtcgctgccgctgctcaaaccccttacgggaagcggagcatgcaggtgaacaggtggaggagcccaagtgggcatgtgttacagtgtgcccttttagccctgccatccatggacagcttgagtgttaatcagctcagtggaccctctgcctttctgcaagggcagagggccagtgtgacagctttctgtatcccgagctcttgtccagtgtcccggaagaatcgagtcacacacgaacttgaaggatgaatgcagggttttattgcgtggtggaggtggctctcagtgggccggatggggagctggaaggggggatcgagtgggaagatgatcttcccctggagtttggctgtccagcagccaaactcttctctgaccactcccagctgaactcctcttggccttcagacattcctcctgttctctctttctctgctgcattgttctgctgttcatctgcttgtctcctcgtctgcttctggagcctggagatcagggtttatatgggtacaggatagggagtgttgtgggccaaaaggcaatgttttgggcgtgaaaacaggaatgactgtccccatttagggccgtgggtctccaggcttgagggtggggcctttgctggggaaccactctcttccatccagtatttgcctgtctcctgtgtgtatcacagtggtgcaatcatagctgactgctgccttgaattcctagactcaagccatcctcctaccatgcagtaaaaaatctccttataacttttgactccccccaaatttaactattaatagcttaccattgaccggaaggcttatctggtctgtagattaacacatattttgtatatgtattatatacggtattcttacaatatagtaagctagaggaaagaaaatgttaagaatcatgaggaagagaaaatatatttactattcattaagtggaagtggatcatcataaaggtgttcatcttcatgttgagttaggctgagaaaagagggattggtcttgctgtcttaggggtggcagaagaggaagaaaatcttcatataagtggatctgtgaagttcaaacctgtgttgttcaagggtcaattgtctattttgataatatgtataccttttgttgttttcctattgctaatgcaacaaattagcacaattttgtggcttaaagcatgcacatattatctgatagttctggaggtcagaagtacaaaatgagtttcactgctaaagtcaaggtgtaggcagggctggttcctcgtcgaggctctggggggagaacctgtttccttgccattttcagcttcaagtggctgtctgcgatccttggcttgtgggccatcctccatctttaaagcacattgctccaatctctgcttccatcattacattactgacttctctcctccattgatcctcctacgtccctcttaagtatctttgcaattacactgggctcatttgggtaatctaagataatcctaacatctcaagatctgtagctcaaccacacactagcagagtcccttttggcatgtaaagtaacacattcataggttctggggatgagggtgtggatatctttgagggatcattattcagcctaccacagatatgttcttgcataccctatctctggaagaaaaaaactgctgagggtagttgcctctggagataggaagctgggggctgacggacaagggtaagacaaaaacgtatgctttactgaatgcccctttgtattttttgagtttgtgtctctgtattctgtcacaaagtgaaatatgctcattgtggatattttagaaattgcaaaaaaagagaaaaacacaaaaatattaatcatagtgcaactgcccagactcagccactattaatattttttatatatttccttatgttatttctattcataattatgtctgtgatagaataatagcttccccaaaatatccaagtcctaatccttagaatctgtgaacacgttaccctaagtacccaaaggaaatttgcagatgtgattaaggatcatgagatgaacagattatcttggattatctggggtgggcccttataatagggaggaagaaaggtcagatagagagaagatgatgtggtggcaaaagtagctgtctaggatacaggaatatgtgtagcctctggtagctagaaaagtccaggactgaattctcccctagagctttcaggaagaatgcagccctaccaacacctttggacttctgacatccagaattgtaagataataaatttgtgtcattttaagctactaaatttgtggtaaattgtttcggtagcattaggcaattaatactatgtctttaataagcattccttcatgctaaaacatgttttgtgaatactgtaatagctctttaatgttattgctgtttattcttctagactgcaagttgtacaagggcagggaccatttacgtcttgatcaccattatatttccaatgtcttgtctgcagtgggcccttaataattattcatttagtaaatcagtgaatacaccacaatttatctaacttttctttttgagacagtttcactctgtcacctgggctggagtgcagtggcgcaatttctgctgactgcagcctcgacctcctgggctcaagtgatcctcccacctcagcctcctgagtaggtgggactacaggcacacaccaccacaccctgttagtttttgtattttttgtagtgatggggttttgccatgtttcttaggctggtctcaaacacctgagctcaagcaatctgcccaccttggcctcccatagcgttagaattacaggcataagccactgcacccggccccagtgttttcctttttaagtagctcctgccatatatagctgataataatattaataataatcgtttaagtgctttacgtactgatatagtttggctatgtctccacccaaatatcatcttgaattatagttcccataatccccatgtgtcactggagggacccagtgggaggtaactgaatcatgggggcagttactgccatgctgctattcttgtgatagtgagttctcatgagatctgatggttttataaggggcttttcccccttttgctctacacttctccttgctgctgccttgttaagaaggacgtgtttgcttccccttctgttgtaagtttcctgaggccttcccaaccctgtggaactgtgagtcaattaaacctctttcctttataaattacccagtctcaagtatgtccttataacagtgtgagaacagactaatagacatacattatctcaatttaatccttacaaaaacctcatgactggtaaatgctattattatccccctcgcccaaagtcacatagtgagtaagtggcagaaacccagatctctcagggtccagattcaacactcttaaccacaacactctacagcttgctaaatattggaacatcctgtacatgctgatttttatggctttttttttttttactaaatcacacatattaatatcttcccatgtcattacacattttatttatttatttatttatttatttatttatttatttatttatttttgagagggagtcttgctctgttgcccaggctggagtgcagtggcacaaacttggctcactgcaagctctgccttttgggttcaagcgattctcctgccttagcctcccgagtagctgagattacaggcaccctccaccatgtccagctaatttttatgttttagtagagatggggtttcaccatgttggtcaggctggtctctaactcctgatctcaaatgatctgcctgcctcggcctcacaaagtgttggaattacaggcatgagccaccgtgcctggcccatttttaactatcattaaaacatgttctggccaggtgtggtggctcatgcctgtaatccaagcactttgggaggctgaggtgagaggatcacttgagctcaggagttcgagactggcctggtcaatgaagcgagaccctgtctctaccaaaaaaaaaaaaaaattagccagagttgatggtgtgtgcttatagtcccagcaacttgggaggctgaggcaggaggattgcttgagctcgggaggtcaaggtggcagtgagccatgattacaccactgtactccaagttgggtaacaatgagaccctgtctcaaaaaaaaaaaaaatgttgactagtattccattgtctgtatctaccataatttctcagtacgatcttattactactaaataggtcttattactaaacattttagattatttccattataaacttaattcagtttgtttttatttttgatatggaaaattcaaatatatagtgaagtagagggaatagtataaagaactcatgtgtctccatacccagcttcaatctgttatatctatgcccctcacctagttccttccaccttgggcctggattactttgaagcaaattctcagacatcatatcatttcatctgtgaatactttagcattaaacactatttttatactataaaattgcctcagttgcctggattatcttcctaaaaaacacatctgatcagacactcaataaatagctgttgaatggcttaatccctttccctggttgcttgaaaatgcagctgactccctactgtctaaaagaattaataccaaacttctttttttttttttttgagacagagtctccctctatcacccagtcgggggtgcagtggggcgatctcggctcactgcaacctctgcctcctgggttcaagccattatcctgcctcagcctcccaagtagctggaattacaggtgcatgccaccacacatggctaatgtttgtattttgagtagagacagggtttcaccatgttggccaggctggtctcgaactcctgacctcaagtgatccacccaccttggcctcccaaagtgctgggattacaggtttgagccactgcatctggcccaaacttcttaaataggcatacgagaccctttatactctgaccacagcccacttcttcaagcttccttttctgttatttattcccatatatatcttccactccacccaccaaactgctttttgtttcctgactgtagtccacattcttctgacccctatctttgcttaagattccattctttgcctgtgctgttccctttgcatgccacgcccatcacacattttctccgtctggaaatactcattcttcaagctccagctcaaatctcttctgtaaagctctctgcatcacactcaaacatagtcagatgatccctcttcttacttgcagtgcctttgagttatacttttatttttgttttcagtatattgtattgtaattatttaatgtttctgctcctcctatgagttccttcagggcaggaacatgtcttatttgtcttcatcagaccatagcacctagcacagatatgtcaggtaagtgtgcactaagagtttgtaaaataataattaattccacaaatatttattgaatatctgtatgccacgcactgtcctaggtatgcagatatgttggtgaaagagacaaagtcccttttatggagcttaaattttcatagaaagagacataaaatacacgagtaaacaaacagatacagtattttcttacaggaataaatgcaataaagaaacaacaggatgatgaaagagtatcatatagtttgtattttcaagatacttctggctctgtgcattgaatggattataggaatgagagtggaagcagggcaatcagtttaggaggctattacattaatctgagtaagagaatggtggcttgaactaaagtggtggtggtggagatggtgagaaacgcgtagggatttaggatatacttagaaagtggaatcatcacgacttgcccatggaggggagcaagggagaggatatagggcagagagagagagagagagagaaacagaaagaaagagaaaaagagaagagaagggaagagaagagaaaagagttgagttttgtttggacataaatttgagatgcctatttgaaatgaataaaacaagagtagcttttggtggtctggcttcattcccctttgtttattgttctctgatatttgggaacaggggtgatagaaggaagaaaatcatttctctgtgacattcaagtcgctacagtttacctagggttttcttctatcccaccctttccaaatgttagatggcaacaaggtgttgttcctctcccctctccttccttctttggtttataaaataaaccgacccacacagctgacccttagcaagggctgtgtaggtctgcgaagtttaataacagttgcagatagattggctaagagaagtcagctggtgggtggcagggcaaataacggcttcatcagagccaaatacggatattagtttccccagtatatatgacaacttgctggtagcaaatgaatcttagaattaagacactgctaaacagtaaagatgattgttcagtattgggtttggctttattttgaaacattagaccctagagtttggatactggcccagtgaggccactggcaaacactattagtgcagattcaggatttttatatttctggaactctacgctatattcttggagactgctgccaaggtgcgcctggccacagaggtctgccttttatgccatagaaaataactgctttttaaaaaaataaatctttaaaagaaaaggtttattcattgtagtttcttgtctagtttcaggaaggggttaaatttggctttgattagtagtgggtttggatggagttatcataaattgtgtccagaaaaatcagaaaagctatttttttcccaaagccatcttctcaaaagattctattgaaatgttggcccgtcttctctcaggggctgaaagctttgatgttcttctttctctggcttgtggtattgtatcagtaagttaattgctggttcacaacagtttatggttaagtccttggaattagaatttttattccaactgatttacctttgggttgacgagtagcagaaagaaagggttcattgtttctaatctataaggcagaataaataatgcagattggtgggaagcatttcagagcaggcattaaaaatagtaaattatattaataagcaaagcctatccaactccaccctcttgactcttgggatgaaactgataaacaaccatccatgttcttttattggctccaaacacatgcaaccagcagagcgaacaacttgctgctctatgcacacttttccagtctttgtttttacttgcccctaactcagacttacttagatttcaaatgtgaacaacagagtctaacagaattcactgtttgtgattttttaagcaaatggttgttaagaaacatctggttatagttaataaagttcctcctgtgtgtgtgtgtatatgtgtgagatatgttttaagttgtaaggcttattgccacattcaggtcttattcttgtcatgctggtttccagaagataactagttaatcacactagtttcagaatatgaaatgtagaggaattttttcttttcctttttcatttcattctctgtttaccaaacaaaacatgactgactgtttcatcactcttcagacttaataggacagtcacagtttaacagtattctttgttatattggcctatggcaaggaattttagaagttgctgagatcttaattattttgtccagttatttctgggggagggtgggtaatatgcttttggcattggacaggatagttcttcattgtttgtctgggctgggcattgctagatgtttaaatacccgcagccattgtgccaagcaaaatcaactctgcatcttgtcagatgccccccaggagtagtactcctttgagattgaaactactgatctagtttaaacccttcctatttcagaggggaagaccgaggtccagagggacctgttcaaagctacacataactggactgcaacctagctcttctgagtcctagattagtgtcctttctcccaatatattttgaggggcttatttaaatacatttatactgattttttttaaaaaaattatttcaatagtttttggggtacaggtggtttttggttacatggataagttcttcagtggtgatttctgaaattttggtgcacccatcacccaagcagtgtacactgcacccagtatgtagtcttttatctgtcaccctcctcccaaccttcccccggagaccccaagcctgttatatcattcttatgcctttgcatcctcgtagcttagttcgcacttataagcgagaacatacaatatttgattttccagtgctgagttacttcacttagaataatggcctctaactctgtccaagttgctgcaaaagacaatattcttcttctttttttttttttgagatggagtctccctctgtcgcccaggctggagtgcagtggcacgatcttggctcactgcaacctctgcctcctgcattcaagcaattttccagcctcagccttccgagtagctgggactataggcaactgccaacatgcctggctaatttttgtagtttttcagtagagatggggtttcaccatactggtcaggctggtctcgaactcctgacctcaggtgatctacctgcctcagcctcccaaagtgctgggattacaggcgtgagccacggtgcccggccaaaagacaatatttcattcctttttatggctgagtagtattccatggttattctgatgttttttgtgcccttagagctttttgactagtgagagggccttcctaggcataagtatgatcaaaaggtggtggaatatggaatttacctagagcataatacaccctcattttaatttaatcaagaaaatttgttgaatgtctgctatgtgacagtctgggaaaatggtagtctcataaccctctacttttgaaataatataaatggaatggggtggtcatatgaaggaaattacttaacaatttagagggtgaccagtttttaaaagttgaaatgcaatgtaatgcttatttcataccggattatttattttctaggaatcaagtataatcaccagcttctttattttttcttcagtcacccctcccccatatacgtttctccccactttccgtttatttagcccaggtcagagtgaagagtgatcaggtaactggcaaacgttcctccttagggaaacaattccaaactcactccctggtcaagttgcttctagatcttggctttgtcaccagtaacactgaggcaaagatataaacagggaacagtcttctctgccatggaatttttgcctcagactaccaaaatgcaattcgttctctcatggatgagagaaagaattgaaagaacaagttggagctctctggggatccctagggggttgtcctcttctggagggccagttgttttccatttactttttcttgttttccatgttgagtttcgctttggaggatgttcctccaacattgcctgttttttttttttttttttttttttttctgggatggagactcgctgtcacccaagctggattgcaatggtatgacctcggctcactgcaacctccacctcctggattcaaggaattgaatccagcctcagcctcctgagtagttggggttacaggagtgcatcaccatgcctggcgaattttcttattgtatttttagtagaggcggggtttcaccatattggccaggctggtctcaaactcctgacctcaggtgatctgcccaccttggcctcctaaagtgctgagattgtaggcgtgagccaccacgcccagccaaacactgcctgtttaattcctttttgtcatgccaaaatgctctctgagatgacttagcagtctgcacttggtctgagatgagaggtgacctatttttctcctccttcatttctgatcctattcaatagcattttttttctttatttcttggtagagatggagtctgtctatgttgtccaggctggtcttgaactcttgcctcaagtgatcctcccatctcggcctcacaaagtgttgggattccaagcctgagccactgaacttggcctcagtagcattttcagtgttagctccatccttagtatgatgaccctcattcttcctcccaagtgggccacacgctacagagatcttgcctatcaccgaaaacaaaagtggacttcatgaattctatgggctttgaccaaatagtgttaataacttgcttttggggagagccccttttctgttctactctctgttgcaactcatctatagatacaagatctattctttttgtgggggtttaaaaaacaggtttactgggataaaattcacataccataaaattcacctatttatagtgtctcattcaatgttttgtggtatattcacagagttgtgcaaccatcaccacaatcaattttagagtattttcatcactccaaaaagaaaccttgtacccattatgaagacggcctactcttaaacttagttcattatcaataataataatatttggtgagggcttattctgtgcattaggctgagtacttgcctttgttatctcatttaatacttaaaaccatcctgtgaattagggactaatattattcccatttttacgatgaggaaactgaggcatgtagcagtttaaaacttgttcctatccaaactggttgtacatggtgaatcctagattctaacttaggccatctggtgccatagcattttattttattttattttattttattttttttaagacagagtctcactctgttgcccaggctgtagtgcagtggcccagtctcagctcactgcaacctctgcctcccagattcaagtgattttcctgcctcagcctcctgagtagctgggactacaggtgtgtaccaccacgcccggctgatttttgtattttagtagagacggagtttcaccatgttggccaggctggtcttgaactcctgacctcaaatgatccacctgccttggcctcccaaaatgcttggattacaggtgtgagccattgcacctggcctggtggcattgcttttaacaaatcataacactgtcacattttgtttataggatgggaccaagcacagttttcactccttttcatttacatgaactataatttgagattttctgtcataaacaggtcactgagtcagtatttattaatcacttgttacttataccatacactgggacagaagcaatgtgggatgcagagaggggagagaaagaaagagacagcgagagagagagagaaagaaagaaagggaagaggagagaagagagagagagattggccctatcctcaagaagcttgccatctaattggtatggctggtccaccttgtagagccacacttgagagatgccatacacatgccacagatggttggtactgttaagctctgtagaaggagacattaatgtgggttggagtgatgagagaaggcttcctgaaagaagtggtctgtagcagaacctaggtgaacctaggtggaaataaaatcaaatggataggagtgggaatgccaggaagtatgttggaaggaccttgaaataggttggagatggttgggagacctttgtgcaaatcagactgtggagggccttgcatgtcagacaaaatagtttgttaaatgaatgtttaacagacatttgttgagcgcttactatgtgccaagcactcttgcagccactgggggtagagcagtgggcaaaatacaaaaaaatccctatcctcaaggaaattgaattctatttggggaaatagatgaaaaacaaataagttagttgtatgatcagataatgtgaaaaaacaaagaagggggcataggaagtgtcatgtgtagggggtagtggctacatatttggattttgaaatttttcatttagatagctgacagccattgacaaacttctcatactatgttttggcatggtgtttatccttgcgattgcctaagagaaggagagctttagaagtgagaagtgagtcttggagaggcttagaggcaggtaggaagctctagggcaagtgggagccaggtgtagcctctgagtcttgcagctgtggtacagtggaaaaagcactggatttggatacatacactttgaactctggcaggaaccttaggtcacttcacttctctaagctttgtttcctcttctgtatagtggggataggagcacctaaccaacaagtgttatcaagattatttgagaaggtgaccacatagttggaagtaaagctctactcagcaaatgtaaaagaacagaaattataacaaactgtctctcagaccacagtgcaatcaaactagaactcaggattaagaaactcactcaaaaccactctactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaatagaaaccctaacatcacaactaaaagaactagaaaagcaagagcaaacacattcaaaagctagcagaaggcaagaaataactaaaatcagagcagaactgaaggaaatagagacacaaaaaacccttcaaaaaatcaatgaatacaggagctcgttttttgaaaggatcaacaaaattgatagaccgctagcaagactaataaagaagaaaagagagaagaatcaaatagatgcaataaaaaatgataaaggggatgtcaccaccgatcccacagacatacaaactaccatcagagaatgctataaacacctctatgcaaataaactagaaaatctagaagacatgggtaaattcctcgacacatacaccctcccaagattaaaccaggaagaagttgaatctccgaatagaccagtaacaggctctctgaaattgtggcaattatcaatagcttaccaacaaaaaagagtccatgaccagatggattcacagccgaattctaccagaggtacaaggaggaactggtaccattccttctgaaactattccaattaatagaaaaagaaggaatcctccctaactcattttatgaggccagcatcatcctgataccaaagccgggcagagacacaaccaaaaaagagaattttagaccaatatcctcgatgaacactgatgcaaaaatcctcaataaaatactggcaaacggaatccagcacatcaaaaagcttatccaccatgatcaagtgggcttcatccctgggatgcaaggctggttcaatatacgcaaatcaatgaatgtaatccagcatataaacagaaccaaagacaaaaaacacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacacgattgtatacctaaaaagctgcactgtcttagcccaaaatctcctttagctgataggcaacttcagcaaagtctcaggatacaaaatcaatgtgcaaaaatcataagcattcttatgcaccaataacagacagagagccaaatcatgagtgaactcccattcacaattgcttcaaagagaataaaatacctaggaatccaacttacaagggacgtgaaggacctcttcaaggagaactacaaaccactgctcaatgaaatcaaagaggatacaaagaaatggaagaacattccatgctcatgggtaggaagaatcaatatcgtgaaaatggccatactgcccaaggtaatttatagattcaatgccatctccatcaagctaccaatgactttcttcacagaattggaaaaaactactttaaagttcatatggaaccaaaaaagagcccgcattgccaagtcaatcctaagcaaaaagaacaaagctggaggcatcatgctacctgatttcaagctatactacaaggctacagtaaccaaaacagcatggtactggtaccaaaacagagatatagatcaatggaacagaacagagccctcagaaataacgccacatatctacaactatctgatctttgacaaacctcacaaaaacaagcaatggggaaaggattccctgtttaataaatggtgctgggaaaactggctagccatatgtagaaaggtgaaactggatcccttccttacaccttatacaaaaattaattcaagatggattaaagacttaaacattagacctaaaaccgtaaaaaccctagaagaaaacctaggcattaccattcaggacataggcatgggcaaggacttcatgtctaaaacaccaaaagcaatggcaacaaaagccaaaatttgaccaatgggatctaattaaactaaagagcttctgcacagcaaaagaaactaccatcagattgaacaggcaacctacaaaatgggagaaaattttcacaacctacttatctgacaaagggctgatatccagaatctacaatgaactcaaacaaatttacaagaaaaaaacaaacaaccccatcgaaaagtgggtgaaggatatgaacagacacttctcaaaagaagacatttatgcagccaaaagacacatgaaaaaatgctcatcatcactggccgtcagagaaatgcaaatcaaaaccacaatgagataccatctcacaccagttagaatggcaatcattaaaaagtcaggaaacagcagatgctggagaggatgtggagaaacaggaacacttttacactgttggtgggactgtaaactagttcaaccattgtggaagtcagtgtggtgattcctcagggatctagaactagaaataccatttgacccagccatcccattactgggtatatacccaaaggagtataaatcatgctgctataaagaaacatgcacacgtatgtttattgcagcattattcacaatagcaaagacttggaaccaacccaaatgtccaacagtgatagactggattaaggaaatgtggcacatatacaccatggaatactatgcagccataaaaaatgatgagttcatgtcctttgtagggacatggatgaaactggaaatcatcattctcagtaaactatcgcaagaacagaaaaccgcacaccgcatattctcactcgtaggtgggaattgaacaatgagaacacatggacacaggagggggaacatcacactctggggactgttgtggggtggggggaggaggagggatagcattaggagatatacctaatgctaaatgatgagttaatgggtgcagcacaccagcgtggcacatgtatacatatgtaactaacctgcacattatgcacatgtaccctagaacttaaggtataataataataataataaaaaataaaaaataaaaaaataaaaaaaaagagaaggctgggtgcagtggctcacacctgtaatcccagcactttgggaggctgaggtgggcggatcacgaggtcaggagatcaagaccatcctggctaatgtggtgaaaccctgtctttaccaaaaatacaaagaattagccgggcgtggtagcgggcgcctgtagtcccagctactcgggaggctgaggcaggagaacagtgtgaagccgggaggtggagcttacagtgagctgagatcgtgccactgcactccagcctgggcaacagagtaagactccatctcaaaaaaaaaaaaaaaaaattagctgcatgtgttggcgtgagtctgcaatcccagctactcaggaggctgaggcaggagaatggcttgaacctgggaggcggaggttgcagtgagccgagatcgtgccactgcattccagcctgggtgatagagtgagactccatctcaaaaaaaaaaaaaaaaagattacttgagataatgtgaatgaaaccttcattagttgtatagtcatctacaaatatgaaaagttagcccttgtggacagtgcctgtgaaaattgtaatgctgttcttttaagtctttccaggaatctgatagtggtaattgaatttttcatgtcaacaaagtcataaatcagaattttaaatcacaaagcacagttggtacaaggcactctataagaggtactgagctagatggtgggagggtagtggtggccaaggcagccttcagggagttttctttgtgctatgtttaagtctgccagcatggaataagggaagcatgactgaggagtaggtgcttcatgcagtgtggccacactccttctgtggccttgcctctgccctttatagcaaccagtaacacacccaccaaacagaaccatgtgtagttccatgatctttctctttctttatctctgtttcctatctctttctccctttccatctcatttatctctctatgctcccccaatccccaattcattcctttacacctacttccatctgcctgaagtgctcttccgtgccatattttccaggcaaactttaagttcacatcctcagcttctgtttcccctcctctagaaagccttctctgatctttctgctgtccaagtgattgcattgaattgcagttgttccatttgagtctccttcactagaatgagttccttgagggcagggattgtgctttgtctgtctctgggtccctggttcttagtgctaggattggcattaaggaaatgcttgctgacttgaaataattgtaaaagtggaagactatatagataaccaagatttatctaggaactccttcaagacttctctatttatacatcttttatgaactgaatcataaaccacagatccagtgactgaagagcagatcagggggaggctatagaatatggtaataaggctatattgcaaagtattgcaaacataattctagagtcagactacgttatagctccttcacttcctagctgtgggacctggaaataagtcgtttcatctctctgtgcctcagttttctcatccataaaatgaagattataatagtccctactttgtagggttgttttgagaattatataatttaatatacataaaatgcttaaccaccctgggcaacataggaagaccccgtctctacaaaaaattaaaaaaaaattagttgggtgtggtggcatgtgcctgtagtcctagctagtcaggaggctgacatgggatgatcacttgaacccaggagttcaagaccatcctggacaacagaggaagaccctgcatctacatagaaagagaagaaaaagcggagacagttcctggcacctagcaagcactctgtaaatgttagctcttctcatctaagtaaaatagaggcatattcaaataaaggaagtttggaataagtctagagatcatttttttctcctcagggatccctgttctgaatctttttttcagatccctgttctgaatcctctcacctcagcctcccaagtagctaggactacaggtgtgcacctccatgccctgctaagttttaaaatatttttgtaaagagaccagttctcgctatgtttggcaggctggtctccaactcctggcctcaagtgatcctcctgcctcagcctcccaaagtgctggggttccaggtatgagccaccatgtctggcacattttcagtttttcatgattacagatagagctgctgtaaacattattatatgtttttttttgtgtgtgaacacacattatttctagagggtaaatgcccatgggcaggactgtgagctcatatatgtacatgtttaattttataagaaactgccaaaccattttctagagtggctgtgacaatttatattcccactagcaatgtataagaattccagcttctctctatccttggcagcacatggtatggccactttgttattttagccttgctaataggtgtgaagtggaatcttgactgggtgttagtttgcttttccataatgactaatgacgttgaacgtattttcaggtgcttaattgccatccatgtatctttggtcaaatatctgttcaaatattttgcctactaatgtaatttgttgttaattttctttattgaatcttatgtattctgtttacataacaaaataataaagtttagtgaatcttttatgtattctgagtatgggttctttgtcagatatacgatttgctaatattgtcttctagttggtggcttgtcttttctaaaatcgtcttatgaaaaaaattagccaggcatagtgatgcatgcctgtagtctcagctatttgggaggctgaggcagtaggattgcttcagctggagagatcaaggctgcagtgagctacgatcatgccactgcactccagcctgggtgaaagaatcagaccctgtctcaaaaacaaaacaaaacaaaacaaaaccccaaatcctcttattagggtctttcatagagcaaaatattttaattttgatgaagttcaatttatttagtgattttttttttttttttgagatggagtctcactctgttgccagcctggagtgcagtggcgtgatctcggttcactgcaacctctgcctcccaggttcaagccattctcctgcctcagcatcctgagtagctgggactacatgcgtgcggcaccacgcccagctaatttttgtatttttagtggagacggggtttcaccatgttggccaggatggtcttgatctcttgacctcgtgatccgcccgccttggcctcccaaagtgctaggattacaggcatgagccaccgtgccctggattgtgcttatggatgcctgagaatatttcacctaaccctagatcatggagattttatcttatgttttcttctagacattttagcattttaggttttatatttagatttgttatgtattttgagttatatttttgtgtatggtgtgaggtttatttagaagtttttttttcttcccccaattgtactagcaccatttgccacaacttaactgtgacaacttagaaatcacttaacctgtcatggcctcactcttcttttctctaaaatggggataataatagcatgtagttcatgtggttaaaggaaagattccagactactatttacatatataaatgcctagcacacaacaaacagttattattagtattcattttatagagtttcaaattttgaggtttaatttcatgattgacaaactttgataacatgtaatacacattgtcccttttcatcccttccaaggatgttggagtacgtgggccagtgctgaggtagggttctggtagatgggttttattgggatgatggctgaaaccacttgtagtcaagaaatgatagtagtttccagctgggaggggaactgaggccagagtcagttcaataaaggcaagagtgtgtagccagaaacacaaaatgaaaaatgaagtcatatgtgatggattaaatgggtaaaggaaaagggttctggaccctgactgtgaataaagcaagatgttggggctccctcttacagaaggaacactggtcctttattcttgtttaaaagtgtcgaacttggtttttctcttcaagatgcccttcagtactgcgttgggagcctcttgccctgttctccaaacaaattcagtctaagaccatgttttgctgtgagctctgctgctttggtgtcaaaacctggtaatgtgccagttcccctttggggaggctttctaaaacatactgctcagcagagctgaaaaggctgaagaaccttctccagaaggtgattgtgcctgtggtaggtcttggtctgggagccatttccaaagctggataccacagctactttgtccatcctcactatgctccctggcactccatgccatgtaggctccccagcaactctcctttgtctccccgagaaagagctgacagttgcaatgtcttttttttttcttaaacttcctctttgatcagtgttttgagatcctaggtgaatacgttttttgtgacaagcatgtgcaagatacgcagaaaggaagtaatgctatggaaaagttgtagtcacaaccagtgtgaccagagatcattatcagtctggtcaagtcactcctgcttggagtagtgtcactggaaactgacactgcaattgacatggtctttgagcttccagatgtggcaaaacaaatgttttattgtacagcaccgaagacacaacttagtttggtgttttatgtgtacatctccaagataataatggcacctgacttcagcccttcgtagtttagaaagtcctgtcatgtttcctatttaatttgattcttacaataagaatgagagagataggacagggattattattcatgttttacagatgccgaaactgtcagggaggcagagttggaggggtacacagtggtcaagagcataggttctgaggcatatttcggtaaaatatataacaacatttttgattttgaccatttgtaagtatacagatcagtggcattggttacattcataatgcaatataacccactgtgcccggctgtggatttctgttgatgtggaaatatagttgttccagttccatttgttgaacagactcttctttctctgttgaatggatttgccttctgtgtcgatttttgacctaaggtctcttttgtctgatattagcagagccacttcaactctcttttggttactattttcatggaattgctttttgcatcttttaagtttcaatctatttttgtctttgggtcaaaagtgagtctgttgtagataacatatacagtcatgtgtcacttaacaatggagatacatgggtgggcatggtggctcacacctgtaatcccagcactttgggaggccgaggtgggtggatcacctgaggtctggagtttgagaccagcctggccaacatggtgaaaccccgtctctactaaaaatacaaaaattagccgggtatggtggcacatgcctgtagtcccagctacttgggaggctgaggcagaagaattctttgaatcctggaggcagaggttgcagtgagccgagatcgcgccactgcactccagcccggcagcccgggtgactgagtgagactccgtgaaaaataaacaaacaaacaaaaaacggggatacattctgagaaatacgtcattaggcaattttgttgttttgtgtattgacacaaacctgtatggcatagcctactataaacctaccaaggctatatggtacagtctattgctcctaggctacaaacctatactgcatgttactgtactgaatactataggtaattataacccaacagtaagtatttatatatccaaacattgaagagggctgggcacagtggctcatgcctctaatcctggcattttgggaggctgaggcgggtggattgcttgagcccagcagttcaagaccagcgtgggcagcatggcaaaactcggtctctataaaaaaacacaaaaattagcctggtgtggtggctcacgcctatagtcccagttactcaggaggctgaggtgggaggatcaattgagcctgggaggttgaggcttcagtgagccgtcataacgccactgcactccagcctggctgacagaacgagacctttttttggaaaaaaaaaaaaaagaaagaaaaagaaaaaacttgaaaggtataggaaaaatatggttatataatgttatggaaccactgttgcatatgtggtctgtcattgactgaaacattgttgcatataactgtagttagatcctgctttttaatccatattgtgggtctctctgcctttgtattgcagagttcacaccatacatttaaagtaattactgataaggaagggcttacttccgacattttggtttttgttttctgtatatcttttaacttttacatcctcattttctcgattactgccttcttttgtattaattgatttttttgtagtggaccgttttgagtcccttcttctttttatgtttatattttatttgtggttaccatggggattacttttaacatcctaaatttataacaaatgagtttgaattgataccaacttcacacttataaaatacaaatctccactcttttacagctctgtcccctctcctgtgtattgttgtgacaaattacatctttctacatactatgttcaataacatagatttataattattttaaagcacttaaaaacaaagtaggatataaaaaagtagagttataaacaaaaagttcgataatgctggcttttatatttgcctgtgtagttacctttaccagagatccttatgtcttaatgtggttttgagtaactgtctagcatctcttttttttttttttttgagacggagtctcactccattgcccaggcttgagtgcagtggtgctatctcagctcactgaaacctccacctccccggttcaagcaattctcctgctttagcctcccaagtagatgggattgcaggtgtgtaccaccacacccagctaatttttgtagtttttagtaaagatggggtttcaccatgttggccaggctggcctcaaactcctaacttcaaatgatccacctgccttggctgggatcaccttccaaagtgctgggattacaggtgtgagccactgtgcctggccggttgagcatctttttatttccactcaaaagattccctttagcatttcttgtagggcaggtctattggtaatgaactcctgcagcctttgtttatctgggaaggtcttactttctccttccgttttgaaagaccattttgccagatgcagaattcttggttgacaggttctatatatatatatatatatatatatatatatatttcagcaatttatgccatcccactgtcttctggcctctgtagtttctgatgagatattggctgttagtcttaatgaggagccttatacatggtaagttgcttttttcttgcagctttcaagactgtctgtcttttgacaatttgtttataggatgcctcagtgtggatctctttgaatttatctttcttgagtttaagcttcttagatgtctagattcatgtctttcatcaaattggggacatttttggccattatttctttaaacattccttttgtccctttttcttcactttctggcagtctcacagtatgtaattttgtctgcttgatgatgtctcaatgacccttagactgttaatctttaatttctctatcttagtgatattgtcattttcctgattttttgttctgcatgttttcctttagctcttttagcatatttaaggcagtgtttttgaagtctttgtctactaaatctgatgtctggacttcctcaggaacagtttcagtcagtttattttgttctttgagtaggctgtactttcctgtttctttgtttgtcttgtgatttttttgttgttgttgaaaacaatgtttgaatattataatgtgttaaccctggatatcatattctctcccttctccaggagttgctggggttttttctgtggttgttgttgttgttttgtagagatgaagtcttgctatgttgcctgggctggttttgaactcctgatctcaagtgatcctcctgcctcagcctcctgagtagctaggactaagagatgactagatttttttttttcgaggagtctcactctgtttcccaggctggagtgcagtggtgagatctcggctcactgcaacctctgcctcccgggttcaagcgattctcctgcctcagcctcctgagtagctgggactacaggcacgtgctaccatgcctggctaattttttgtatttttagtagagatggggtttcactgtgttggccaggatggtctcaatttcctgacctcgtgatccacctgccttggcctcccaaagtgctgggattacaggcgtgagccactgtgcccagcaattttttcttattgttaaaattcttagtagtattttggtttacttacttttccaagctacttctgcaaagactatatcttgtcctgtatggtcactgaagtctctgttccttaaattgtgttcagtgagaattttgacacagagtttctgaaatacaaggagctaaaaacaaacaaataaacaaacaaaaaccacctctactcatctttcctgattggttgtgtgtgtgggtactccttcagcacttagccagacttgcattgcacttataaactagctcaaggtgaaagcttagtcctctcaggaattttctgagtatgcttgttttctggggcatgcatgtggctttctaaattccccatatacatggttgcgtttttttttgagatgggggttctcactgtgttgcccagactggagtgcagtggtgtgattatggttcactgcagcctctgcctcctgggctcaagtgattctctgcctcagcctcatgaatagctggaactacgggtgcacaacaccatgtccagctaatatttgttttttgtttttattatttgtgctgatgaggtcttgctatgttgcccagggtggtctccaactcctgacttcaagcgatccttctgcctcggtctcccaaagtggtgggattacaggcatgagccaccatacctggccagcagttgcttttgaacgtcctcattgtccaaggaaaccattcatctgccccccatcagctttttctcccatgtcttagccagtgtattgtttgtttcaactataataatatggcccagacatctgagggttattaggtcagcgtgcagtgtttttgggcactactcaccatttctagcttgagttttgtattaggtaaaacaaacacaagtgcctggccttagttcttcaggtagcctccagactagtttgaacagttgtgtattagtctgttctcacaatgctataaagaactgcccaagactgggtagttcataaaggaaagaggtttaattgactcacagttctgcatggctggggatgcctcaagaaacttacaatcatgaccgaagacacgtcttcacagagtggcaagagagagaatgagtgcccagtgaaggaggaagccccttataaaaccatcagatctcatgagaactcactcaccagcccaagaacagcaggggggaaactgcccccatgattcaattatcccttgacaggtggggattattacaattcaaggtgagatttgggcgggggcacagagccaaaccatatcaagaagtatacaataatttgtatttaaggtttgctctattccctctggaatcagggtacagggttgcacactgggaacgtaggctaccatcactttaaaacaaaaaatgccactgtgctagagaaagggtgggttaaaggcaagtaaaaatgccacaaaactttcctaccattttgaggtgacctgttttatgattcagcattcacttgggtcacgtaaagttttgacttttttccagagttcaataaagttgattctgagagtttctgcttgtgttttttttttttttttcccgagacagagtcttgctctgttgcccaggctggagtgcagtggtgctatctcggttcactgcaacatctgcctcccgggttcaagtgattctcctgcctcggcctcctgagtagctgggattacaggtgcacaccagcacaccctgctaattttttttgtatttttagtagagacatggtttcatcaggctggtctcagactcctgacctcaagtgatctgcctgcttcagcctcccaaagtgctgggattacaggcgtgagccaccatccccggcctctgcatgtgtttttgatgtttctgtgggagaacaagagcttggagcttcctggtccaccattttgctgatgtcactctgactactctttttaatccacactccctaacttacagtagcgtcctggctccactctgtaaccttgaactagttacttaacctctctgttttctttagtgcaaagttgggtataaagatagtacctacctcaaaggatagttgtaagaattaaataacataattcatgtaaagacattagtatagtgtgtggtaagttaagtgctcaataaacgttagttatctttggaaattacaccataattatatgtaccactaagaaagaacaaaatgtcagttagcatgtggcatgccattgatagtaaaatgtatcgtaatttcaaaaatgttaaaatgtaaaatatgatgactgggcatggtggctcaaacctgtaatcccagcactttgagaggccaaagtaggaggactgcttgaggccgggagtttgagaccagcctggccaacatagtgacaccctgactctacacacgggcacacacatacctgcacatacacacaaattaattgtctgggcatagtggtgaacacctgtagttccagctacttgggaggctgaggtgggaacattgcctgagcctgggaggtcaaagctgcagtgagccatgattatgccactgcactccagcctgggagacagagtgagaccctgtctcaatttagaaaaaaaagtcaaataggtgtattttacaactgattaattatcatatcaccatcattatcactatgattgccaggcctcacctggtgcaggttttacattttgcaggcaaggcagctaggcctagagatggtaagtgacttgctcatggatttgtaggcatttatgtcatagccagatctggatcaggttccctgactcttattctgggtacccagagagactggggccccagtctctcacaactagtagtttatattataaatactattctgttatgtctcactgttgtaggtgtgttagattttcgtcagcaatgtgctcaaagtgagaagaataggaggaatttgttttttttttttggagaaaaagttgctgaagtctagctgggtaagttgagtcttttctgagagcatgagtgtgggattaaaaatcagatgtcactctcttgccatgagaccttggatagtcacttagtctctttgagccaaacagtgttagaaatctccaaaaaaaaaaaaaagggaataattgctactccatagagttgtttcagagtgtgaaatggcatcacttctaagaatactgcctggcacatggtagatttccactcagtgttggttctcttttctactcctttgagagaagtgggctcagtgacattctccctgctcagctcaaactttgtttatgtttatgagtgtgtagaattagatcaacattgttctctgtggcggatttgttagtggctgagggaaaggtagcagctggatgctgtaattctctcgagagacattcctactgctgagtgaggaggagagcacagctgtttgtggaaaatgaacaaaatggtaattgcctcgtgtcagctggtacattctgagacttttgctcttgttgatgttttcttcagtggctgccttatgttaaacatgcccctacccatttgctgcactggtcttgttccagcttcttcaatatgctacgtaggctctttcatctcctataccttgctcacgtggtttctctcaaattccaattttttttttttcctttttgtacctagcaaactcctacatatcctttaagtctctgctcaaatgtcatttcttttgtaaggccttgttgaatgactcttttgaagagtaacattattcctatatctggaaccgcatggtataatttatttgtttaaatgcatttctcctctattagcgtctatgttcatttgaagacagtggccatgtttatttcttctttgtattgcacaggcctagcacatggagcagttatcatagctgaagtttactattgtccatattatctcacaggctttcacactcaccctgtaaagtagatactgttgttattcccattgcacagatgaggaaagtgaggattagagaagttaggtaaatcatcaaggatcacagggcaaggtgattgaggagcatgtagtagaaatttgttgtgactccaaggtcatgctgttaacctctgtgctctagcatggtgcagtccaatagaactttctgtgattatggaaatgtctgtgtgttctttgcaatatagctactgagcacttaaaatttgcctagtgtgattgatgaaatatatttttaattttattaaattttaatgagttgaaatttaaatagccacatgtagaaaactgaactctgatctcttaatggctgtctagcattttcttttagccttaactcagaatttctctcaactgttcttatttcatcaattactctattaaagaaactgaattacatcctgatggaaacagaatgatctccttttcttaagacagttatgtatcttttagcagtctatcgttattatttagagttggtgttaaggctgtagaaattggaaaagttgttgggaataaatgttgtcatcactcttaaacccagttttcgactatattaagtataaagtacaaagatgaaacagattgcaatagatttctgggggaaaaatgttacttctctggctaacacacaaataggcaaaaataattattccaaaggaagtttaaaatcacagggatactacagtctagaagtgtcccatcaaagacacttgctgttgggctgaaggaacaggaagttatgaaaagcactcagtgcctaaagtcactgttgacatgtcaagaggtcctagagaataatccaagacaggctgttcttgtgggtagatgttagagatagatgaagaatgcgttcttattaatcattgagaaaatccagtctctcgtacagcatatgcattgaataagaactgggcatgttcaaggaaccttagtgctcaaagaattctttgggctcttcttgtatttcagttcacacatattttaaaaacattagtatggaaaatttcaaacatacacaaaaccagagagttttaatataatgaaccctctagattcatcacccaactttttttccaatctcatttcaggtaccctcaattcccccacccaaaacacacatggtatttttcttctggagtattttaaagcaaatcccaggtatgtcattatacccatatatatttcagtatgcatttctgatacggactgttttagtatatataaccactgtgacatcatcatatgcaatacaaattgtcagtaatttcttactatcatccactagccagtctatacctatactctcccaattgtttcaaactgtcttttttaaaaaagttaacagccaggcatggtggctcatgcctgtaatcccagcaatttaggaagctgagtcaggcagctcatctgaggtcaggagtttgagaccagcctggccaacatggtaaaaccccatctctactaaaataaaaaaaaacatagctgggtgtggtggcacgtgcctgtaatcccagatacttgggagactgaggcaggagaattgcttgaacctgggaggcagaagttgcagtgagctgagatcgtgccattgcactccagcttgggtgacaagagtgaaactctgtctcactaaaaaagaaaaaaaagttaatagatcctatttttaatttttttattatttaaattttttttaaaaaaatttgtctttgagatggagtcttgctctattgcccaggctggagtgcagtggtgtgatctcagctcactgtaacctctgcctctcagttcaagcgatcctcatgcctcagccacctgactagcttggactacaggcacgcgccaccgtgcctggctaatttttgtatttttagtagagatgggtttttaccacgttggccaggctggtcttgaactcttgacctcaagtgatccacccgccttggcatcccaaaatgctgggatttcagatgtgagccaccgcacccagccaagattctatttttcaaagcagtttcagtttcacagaaaaattgaggagaaagtacagagtcctcatatacctcccaagccccctcctccggtttcccctattaacatcttgcattagtgtgagacatttgttacaattgatgaaccaatattgattgctacattattattaaagtccatagtttacattagaattcacactttgaattacatgctaagacttttgacaaatgcgtagtgacatgtatccaccattacagtatcatacagaatagtttcagtgctgtaaaccccacccccaaccccgtgcctcacctagttatcccttcctctttccctttgagctcctggatgtacttcatgatgctttcatctatgtatacacgtagaacggctaaatcaagctaattaacatactcgttacctcacgtacttattttatggtgagaatatttaaaatctactttatttgcaattttcatgtatacaagacattgttattatctataatcacatgcttgacaatggatctcttgaactcattcctcctgtcaatatgaaattttgtgtcctttgaccagcatcttcccaatctcttctcatccccctgctaactatcattctactctctacttttatgagttagactttttaggattccacatataagtagatcatgcagttttcacttcctgtgcctggcttatttcactagcataaggtcctccatgttcatccctgtgttgcaaatgtcaggatttccatagcaagaacacaatcaacagaatgaggagacaacttatgaaatgggataaaatatttgcaaaccatacatatgataagagtttaatatccaaaatatgtaaggaactcaggcaactgaatagtaaggaaatgaataacctgatttaaaaatagacaaaggacctgaaaagacatttctcaaaagaagacatataaatggccaacaggtatatgaaaaaaatgctcaacattagtagtcatcagggaaaggcaaattgaaatcacaaccatataccacctcctacctgttataatcactattatcaaaaagatgaaagagataagtgttggtgaagatgtggataagtgtgtacactttgtgggaatgttaattagtatggccattattgaatacagtatgatatttcttcaaaaaattaaaaatagaactatccaaaggaaatgaaattggttgttgaagggatgtctgcactcctgtgttcattgcagcatcattcacaatagccaatatttgtaatcagctcgagtatctatcaataggtaaagaaaacgtggtatgcatacacaacaaaatagtattcaggcttctgtaattttaattgagcatttgtagggttccattttctctcagcatattaattatacttcttttaaatctttttattttattttacatatatacatatatattttttttattttttatttttattttttttttcagatggagtcttgttctgtcacccaggctagagtgcagtggtacaatctcagctcactgcaacctctgcctcccaagttcaagggattctcctgtttcagcctcccgagtagctgggactacaggcgcccaccaccacacccagctaatttttgtatttttagtagagatagggttccaccatattggccaagctggtctcgaactcattaccttgtgatccgcccaccttggcctcccaaaatgctgggattacaggtgtgagccactgtgcctggccttatttttatttttaagactactcaagtgcagtagtgagaagggggcaaagagtagaacaagaagtttgatttgtaactgactgtgaacaatcagttgagataactcactaccctcagaccagcccttcttttaaaactttttttggtgtttgccctagagtttgcaatgtgcatttagaaagagccaaatctattttcaaataacgctacactatttcacaggtagtgttagtatcttatagcagaagattaccaatttctttctcgagtcccttatgatattgttgtcattcatttcagctatccatgcactgtcatcactgaatacattgtccctatcattattttaagcaaatggtcatctgttttttgtttctgtttttggtggtttttgtttgtttgtttgtttttgggtggagccagggtcttgctctgtcacccaggctagagtgcagtggcatgatcttcactcactgcaacccccacctcccgggctcaagacatcctcctacctcagccttccgagtgggtgggactaccggcatgtgcctggctgattttttgtatttttggtagagacagggtctcactatgttacccatgctggtcttgaactcctgagctcaagcgatcctcccacctcagcctctcagagttctgggattatagttgtgagctactgtgctggttatctattttatcaacagctggacatggtggcttatgcctgtaatcccagcactttgtgaggttgaggtgggaggactgcttaagcctaggtgtgaggcaccacggggagttcaagaccagcctgggcaacataatgagactctatttctacaaaattttcaaaattagctgggtttggtgccgcgtcactgtagtcctacctacttggaggctgaggtgggaggatcacttgaacgcaggagtttgagactgcagtgagctatgatcgtgacactacacttcaacttgggagacagagtgagatctcatctctaaaaaagacaaaacaaaacaaagcacctcgagccactcattttaagagttgagctgatttacgtagtgctacccaactatattttcctgtatatgtaattgcagacactgttctaagcactttacacatattaacttatttaatcctcacaggaaaacttataaggttggtgctgttaggatgaccattttacaaaggaggaagctgaggaacagaggggttaagtaacttgcctaatgccacagagcaattacatttcagcctggtgatttgaacttaggcattctggctctcatgctgtactaggcaattctttttttttttttttttttttttttttgagacggagtctcgctctgtcgcccaggctggagtgcagtggcacgatctccgttcactgcaagctccgcctcccgggttcacgccattctcctgcctcaacctcccgagtagctgggactacaggtgcccgccaccatgcctggctaattttttgtatttttagtagagacggggtttcaccgtgttagccaggatggtctcaatctcctgacctcgtgatccgcccaccttgatctcccaaagtgctgggattacaggcttgagtcactgcacccggcctgtactaggtaattcttagctggtggtgagacatcactactaaatgtggatgggatgggatgggatggatatgttatttcttgggtctctctataaactgttccaggaggctcacgccccagggaaatttcctttcaattgtctcttatattttccttctatgatcttttgtgctgcctcacaaaaacagaaagccattagtttcatcttctagccacatatgttcataaaagctgtaaaacccatgagtatgagatgcttggaggcttgtagttattgtaaataatttacaaatccatatgtaccccaaatttttctgcagaataataatgtgtgcactattaaaaaatattaaaaattacagctataatcatatgagagggtaaaaaatattgagaggtatgaaaaatagttcatcatacataataggaggtaaatgttgctcaagagagagggtgattgtgaattaaattttttaaaaagcagagataagtaaaaacaaaaaccttgggttaaaaaggggaatcctagccacactggctcttccagatgagaaaactttttccaaactgtagaccagggctgccattttgagagaatagaaaatgatgacatttgtgaactggtagtcagaacactagcattgggggcttttggcagtggtagtcttggatttgaaccacatttccactgcttaacagtcgtgtgatttgggacaagttactcaatttctccaacccttagctttcttatctgaaaaatataattcctgacctacaaagtaaaccacaaaataggtcacccagcaaataaagtggccaagaacttgagttttgatggtatgaagtcataaataagattatggatgtaaaagtgcctaacacaaaactagatatttgacaaagtaagaatcctctaaaggcattagtcaaagagcttagtattagtatggtagacaacagtgacttgggaattactatgttgttctagttgatttcttaacagctttgacctctttatatcatttggaaagaatcaaatggacctcaagaggttatttagttctgtgctctgcctcttgtcagacaaacttcaaaattcagtattccctttgttataaatcctgtttgaaaagatatctaggaaaacgagcacatgacctcccaaggtagacagtccctgtgtacaatgacttataagccaaattgactatttattttctttctttcttcattattattattattactttttgaaatggagtctcactccattgttcaggctggagtgcagtggtgtaatctcgactcactgcaacctccccatcctgggttcaagcgattctcgtgcctcagcctctcgagtagttgtgactacaggtgtgcagcaccatgcctggctaattttttattttattttattttattttattatttttttttttttagtagagatggggtttcactatgttggccaagctggtcttgaactgctggcctcaattgatctgtccctctcggcctcctaaaatgctgggattatacgcgtgagccactgtgcctggccctaatggactatttcttaatgtaattagtacttgctacttattgcttgggtccctaaatagtatgttttcatggagtaaccaacttttctggcctattttggcctttaaatattatctatctcaataaaaacagtcaaacaaaatcaacaggcatcttaacaaaagcttgtggaagtcagtgtggcgattcctcagggatctagaactagaaataccatttgacccagcaatcccattactgggtatatatccaaaggattataaatcatgctgctataaagacatatgcacacatatgtttattgcagcactattcacaatagcaaagacttggaaccaacccacatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacgccgcatgttctcactcataggtgggaattgaacaatgagaacacatggacacaggaaggggaacatcacacacaggggcctgttgtggggtgggggcaggggggagggatagcatcaggagatatacctaatgctaaatgacaagttaatgggtgcagcacaccaacatggcacatgtatacatatgtaacaaacctgcacgttgtgcacatgtaccctagaacttaaagtataataaaaaacaaaacaaaagcaaaagcaaaacacagatacactctgttttgctgagagctagagaaatgctgcggaaaacctagaagtagctgtgagaatatatatatcctggctgatttaggtatcattcacagagcaaataattcacctacttaaattgtacaattcactgagttttagtatattcgcagagttttgcgaccatcaccacaatcaattttagagcattttcttcaccctaaaaagaagcctcataccaaataacagtaactccttattttcccccattcctgctagcactaggcaaccacaaatctttctgtgtctgtagatttgcctattctggacattttatataaatgggatcatacaacacgaggtttttcgtgactggcttctttgatttagcataatgtttaccaggttcatccctattgtggagactgttttaaaaaatctctgcatttggaggtcagacctcagtgtattcagaagggctctccagagacttagaaccaataggatatgtatctatatatatatacagaaagaggggcctggcgcagtggctcatgcctataatcccagcattttgggagaccaaggcaagtggatcacttgaggtcaggagtttgacaccagcctgggcaacatggcaaaaccccacctctactaaaaatataaaaattagccaggcgtggtggcaggcacctataatcccagctcctcgggaggccaaggcaggagaatcgcttgaacccaggaggtggaggttgcagtgagccaagatcataccactacactccagcctgggaaacagagtgagaccctgtctcaaaaaaaaaaaatattttaaggaattggctcatgtgattgtggaggcttggcaagtccaaatacctaatgggagaggcaggcaggctgaagactcaggaaggagttgcactttgagtccaaaggcagtctgctggagaatcccctcttgcttgggggtaaatcagccttttgttctatttaagccttcaactgattggttaaggcctacccacatcacgagagcaatctgttttactcaaagtccactgatataaacataaatctcatccaaaaacacccctacagaaacatccagaataacgtttgaccacatatttgggcaccgtgccccagccaaaatgacacataaaattgtaacatttggcgattttttttttttttggaagaagtcttgctctgtcacccaggctagagtgcagtggcacaatctcggcccactgcaacctccaccacccgggttcaagcagttctcctgcttcagcctcccaagtagctgggattataggcatgtgccaccacccacacccagctaattcttttatttatttattttttggtagagatggggttttgtcatgttgaccaggctggtcttgaacttctgacctcaggtgttccgcccacctcggcctcccaaagcgctgggattacaggtgtgagtcagcacctggccacacttcgctatttttatcctgtgaataggtaaacaaacctaacattgaggattgtctttcttggaagcatatgcaatttaaaattagcaccagcaattgctgtattttgaatctctttgtgtaaacaactactctgagataaagaatgacttttgaaatgacccagaaagaatatggatcttgcacggtagcctcaaagctaagtaaagaaaggagttcttttctgtcttcttgaaataggaaaatatttcatcttgaaactatctgagcctttcttcctgccctggatagcctatatcagcatatgaactggagagagagagattaactacatgtatcagccagaaactcaaatgatcaaatgtcaggactaccttcaggttttattggtctacgttccacagcagacattaatcttccacaatggacagatgcaatgttttatgtacttctgtattttatccctgcctctgtcctatgcaatttcctttcctactttcttaaaatgaattcgttttcttgcagattctagatgcagttattaagttttctgacacaactagaaagattttcctttgtctctgcatttcaagagaaagcttctctagtcacagtcatgtaaaatgtaaaactcttgagtacaaatgaaggaattctgcagagcttaaataaatacaggctgactaatatgtaggggaaactagcctagtcactcagagtctccagtctgatgccactgagttataggcaccttcctgggcccaacagttgggtttatgaagacaggatctggatgtccattccaggccccagaatatttacctaagatatatgtactcataaaatcagaaagaatatttgactgcagataggaaataattagggatgagcagagccttatgatcacagaggtagtgggaggtatggccagaatttgaactacaaactcagtgttctttctatctcatcatgacgtttcttttagttttttttttttttttgagacggagtctctcgctatcacccatgctggagtgcagtggcgtgaccttggctcactgcaacctccgcctcctgggttcaagtgattctcctgtctcagcctcccaagtagctgggactacaggtgtgtgccaccacgcccagctatttttttttttagtagagtcggggtttcaccatgttggccaggctggtctcaaactcctgaccgcaggtgatctacccaccttggcctcccaaagtgctgggattacaggcatgagccaccgcgcccgacttttttttttttttttttttttttgagatggagtcttactctgtcgcccaggctggagtgcagtggtggtgtgatctcggctcactgcaatctctgcctcctgggttcaagcaattcttgaactcggtctcggtctcccgagtagctgggattacaggtgtctgcaaccacgcccagctaatttttgtatttttagtagagatggggtatcaccatgttggccaggctggtctcaaactcctgacctcaagtaatctgccagcctcggcctcctaaagtgcagggatcataggtgtgagccactgagcctggccttatcataacttctcaaacactgctcaacaatgccttgtccagagacattatcaatggctaatatcattttaatgctcttttattaaactatgtatatactgagtttgtataaatagtggatttaaaatgagtatctgtgaataggaaccttattctttgaaataatgtactctaactttttcgatttcagcatctgttttgctgagtcttcatcactatggtctaggatgttaagtcaataatattgaaaggtctgcctgtatattttgttttagtactaactttttacaatattatattttaggaagaaaaaaagactaatttatgccttgtggtgtagctcctttgagtgtatattaaaacagtcatggttgctgaaatgaagaaattgagcaatggaaattgtgaaagtagaatggaatcttacaaataagttaatatgagaaataattataaggtattatcattttcttgattatttgatcttattatgctttaatattctacaaaagcatttgtcattttaagtaggaaacaaaaacagcataaatttactttttacacgttatttatttatttatttatttaaggtggagttttgcttttgttgcccaggctggaatgcagtggtgtgaccttggctcattgcaacctcctcctcccgggttcaagcgattctcctgcttcagcctcctgaatagctgggattacaggcacccgccaccatggctttttttttttttttttttttttcctgtagagacggggtttcaccatgttggccaggctggtctcaaactcctgacctcaggtgatctactcgcctcagcctaccaaagtgctgggattacaggcatgagccaccatgcccggcctactttttacactttaaataggtgaattttatggtatatgaagtatgtctcaataaaagtatttataagaacctgcacttaatctccctgttgttctgatttttcttaatgcaccttctttttttttgtttgagacagggtctctccctgtctccaaggctggagtccaggggtacgtgcgttcatggctcactgcagcctcggcttcctgagctgaagtgatcctcccacctcaacctcctgagtaactgggaccacaggtgcaagccaccacgcctggctaattttttgaatttttgtagagataggatcttcctatgttggccaggctggtctcgaactcctgggctcagcaatccactcgcctcagcctcccatagtgttaggattacaggcgtaagccactgcaccgggcctgatacacctttcttctgaagaaacttttctttccctctgtggatgacttttttcccttcttaccataaagcattgagatgttcctcctgcttcgttgctctttcctataactagttttaaaaatagttgtctaaattttagagaaagtaaaaccctttctagttctgacattggaaggactttatgaaggattttgtgctttagtttcatcaaagtctcccaatgaaacctaagttgctttccattctaagcctggtgtttattttaataagtgaatgttttcccatagctgggggaaacatctaggcctcattctcctctttctgccaataaatatgttataattgtagctccagtgatactatttctttacattaaggtgaaagcttacaagaaatgcatgcatagcaaatcattgggctttgggatcaaagcactgtccggctgataatctagtttccatcaaatagtgatgtgttttgaggagggctgggtgttttttttttttcatttcttttgttaattaattgtaataaaagcctctaaaggatttttctggagactgtctaccaaatcttctgaacagggaaaattttataggaataatattaatattctttggaaaattttccaaagtttaagccccttaagaaggttttaccttctgggtgcggagttggatttaacaaacatttctggctgggcgtggcggctcacgtctgtaatcccagcactttcagaggctgaggcgggcagatcacgaggtcaggagatcatcctggctaacacggtgaaaccccgtctgtactaaaaatacaaaaataaattagccgggcgcggtggcgggcaactgtagtcccagctacttgggaggctgaggcaggagaatggcgtgaacccgggaggtggagcttgcagtgagccgagatcgcgccactgcactccagcctgggcgacagagcaagactccgtctcaaaaaaaaaaaaaaaaaaaaagaaaaaaaaattagccaggcgtggtggcaggcacctgtaatcccagctactcgggaggctgtggcaggagaatggtgtgaacccgggaggcggagcttgcagtgagccgagatcgcggcactgcactcccgcctgggcgacagagcaagactctgtctcaaaaacaacaacaacaacaacaaaaaaccagaaaaccaaacatttctttggtggctgctgggaggtcctgtactagacccaggggatggagagatgaagcaaccacagtgccagcctacaggtgtcccacggctggatgagagagacagggtaattcacaaccagctgtgctttggtgaccatgtttagtgaaccaaatttggaatatatggtcattattaatagcagtgtacttatgtgcttatggtaacaatgagatggaatattttaaactggggccttccttattttctgggatatatagtatcatatacagataaatcgaaattttgtgactcttgttcaagagtactcctgagtttacagtcagtggtgaggtaagaggaaacagtgttactgacttctttgcttttttcttactcctcccctgacattttcaggtgggtgaaatctggttgaggggacatcaaaagaatttcagaaaaataggccaggtgtggtggctcacgcctgtaatcccagcactttgggaggccgaggtgggtggatcacgaggccaggagttcgagaccagcctgaccaacatagtgaaaccccgtctctactaaaaatacaaaaattagctgggcgtggtggtgctcgcctgtaatcccagctactcaggaggctgaggcaggagaatcgcttgaacctgggaggcggaagttgcagtgagctgagatcatgccattgcactccagcctgggcaacagagtgaggctcatctcaaacaaaacaaaacaaaaaacagtttcagaaaaataaagtcactaaaagaccctgtgtggtctaaggggtatgaaaatatggcagaggcagctctatgccctagtaacacttggcattttaaaggctttttttgacctggtgcaatggcccacaactgtaatcccaacacttggtaggccaaggtaggcagactgcttaagtccaggagtttgagatcagcctgggcaacaagtgagaccctgtctctataaaaaatttaaaaattacccaagtgtggtggcatgtgcctgtagtcccatctacttgggaggctgagtgggggaggatgtcttgagtccaggagttcaatgctgcagtgagcactctagcctaggtgatagagcaagtctctgtcggaaagaagggaggaagggaggaagggagggagggagggaggaaggaaggaaaggaggaagggaggaagggagggagggaggaaggaaggaaggaagggagggagagagggagggagagagggagggaggggagagagaaagaaaaaggaaagaaagaaaagaaagaaaaagcaagcaagcaaaagaggaagagaaaaagaaagaaaggcaggctcttcctactatgtaaatatgatttggttattcactggttgttaaaatagttcatagtttgaaaattaaacttattaaaaattatttattttgttgatacataatagatgtacatattttcaaagtacatatgataatttgatactttcatataatcaaatcagtgtaattaaggtatccatcaccttacatatttaactttcttaatgctaggaacatttgaattgttgtctcctagctgttttgaaatgcacaatagatttttttgtattttttaaaaattatactttaggttctggattacatgtgcagaacgtgcagttttgttacataggtatacgcatgccatggtggtttgctgcactcctcaacccgtcacctacattaggtatttctcctaatgttatccctcccctagccccccaccccctgacaggcccgagtgtgtgatgttcccctccttgtgtccatgtgttctcattgtttaactcccacttatgagtgagaacatgcagtgtttggttttctgatcttgtgatagtttgctgagaatgatggtttccagcttcatccatatccctgcaaaggacatgaactcatcctttttttatggctgcataggattccatggtgtatatgtgccacattttcttcatccagtctatcattgatggacatctgggttggttccaagtctttgctattgtgaatagtggcacaataaacatacgtgtgcatgtgtctttatcgtagaatgatttataatcctttgggtatatacccagtaatgggattgctgggtcaaatggtatttctagttctagatccctgaggaatcaccacactgacttccacgatggttggactaatttacactcccaccaacagtgtaaaagcattcctatttttccacaacctctccagcatctgttatttcctgactttttaatgatcaccattctaactggtgtgagatggtatctcattgtggttttgatttgcgtttctctaatgaccagtgatgatgagcattttttcatatgtctgttggctgcataaatgtcttcttttgagaagtgtctgttcatatcctttgcccattttttgatggggttgtttgtttttttttcttgttaatttgtttaggttctttgtagattctggatattagccctttgtcagatggatagattgcaaaatttgtctcccattctgtaggttgcctgttccctctgatgatagtttcttttgctggaaatgcacaatagattaatgttaattaatctatccagcatcaggtcttaggaaatttaaacttctttagatggcattcaagctattcacagtttgtcttctatttgtaccacttctccagttttatcttctatttctcccctccacacctcctacttgccaaatgcattgggttctcagaatatttctaatttccttttggattccttgtctatttatctgctgtttcctctgcctggaatttcctcctccattctcacctgtgtgaacatctccttatccttgaagtcatagccaaatatctgtcactcttctgtggagcctttcctatgccaaaacaattactctgttgttcgtctttgtagccctagtgcctatcacaatgcttgtcaccaaataggtgctgagtaaacattttgcatgaggttcattcgttttcatactataatagcaaatatgctccctaaggaaatttgaaaaatacagaagaatataaataagaaagtagcaatcatgcacagccgcagtaacaaccactttttttttttgacatattctagtcttttctaagtatatcatatattttgtagatggttgagattgttttggtaaaaggttgataaattgctctctttattacttctttccactcatgtttcatgatcccctgatggtcttcttgctctggctgtgttcatatagttatattctctttcctccccatcttccacttgcacacttgctagttccctcctcaaaaacctaattagatgtgtttctctttgttggctatgtcctccaccttcactaaccttgtttttcatcaaaacctgttatcaaaccaatagtcacaatgagttttgcatgattgaacccatctacttctctacctgatcctctaacactgatggaaattaaatatggatatttaagctgtaagtgaccttggggaggctagtcctcccttgtcattttcagataactcatgtgccccacacataggtggtggtaagtgtgtagtagggccctccctattcctagccttttgttcttactgaggtcttatagctggtaattggcagcatcaggactagagtccaggtctaactgattcctaagctaacctatattccttgataggttgctctgttaaaatgttatttggttgttgaagataacttttgtctccaaaatccatgtgtcttttctctcttaccaaagtgctttgcaaaattaatgttccccacacattagcctgactgaccaactgacccaggatagaatggttccttgctttggaacttctcccaggctcacccagagagcttcttagcagagctaggaataatattcatatcttctaatgtctagattttcagtttaggccatgagagccagctgagttctctgaggagagttcctcatttttttttaatcaggaaatatagaaatcaatatgtgagtgttagcttggcacagtggctcatgcctgtaattccacctttttgggaggctgaggcaggacgattgcttgagcctgagagtttgaaaccagcctgagcaacatagagagacctcatctctacaaaaaatacaaaaattagctgggcatggtggcgtgcacctatggtcacagctactcaggaggctgagattggaggatagcttgagcccatgagatttgatactgcagtgatctgagattgtgctactgcactccagcctgggtgacagggcaaatccctgtctaaagatataaatatatgggtgttaaaatttgatcactggcaatgttaattcaggattcacagaatcataagatgttagaactgagaggagcctttgaagttctgtagtgcagccccattttactgatgaaggaaatgaggtcctgagagggcccaaggtcacatagctgtaaatggtggggaaggtactagcaggagcctcaggcctccaatactaaaagacactggagaatatattaggcagggccacaaggtaggtgaagaagaaagtcttgggatatgtgtcttttcctctgacatattatagcatgtgtcatatttgtgaatgggaaggggtccacaaaaataacatttgcttcgtacactctagttctgtgttgtatatacacatgaaggattgtcacaaggtaggtaaacaaattagattgttttcccaaaagaattctcgcagagaaattgagcttactttgtcagctttttacgatgaacagaatttggagtataatgatttgggggctgtgggttccccgtgtgcaaactaatattctcagcaaacacactttgcagaaagcagctagagttgatggaaagaggtctgtcctgggattaaatactggtcctgctggaaacttattgtggacaattaatagggaccttttccctctcccagcctcagtttcctgttatgtaaaatcagagattacatttgttcatttcatggattttcttgtgctgatatcttatttctaaggtcattttttcagctttctgctgaagcagtcactcctctcagctatttgctgtattccaagagaggtctccattctctccttattgcctaattagattgttgtatactacagactgatggacatgctgtgcttttcatttatgcagaagcctttgttttctcttggatttcccagttgttttgcttctggttgatttatccttggactctattgttatttgatacagcctcctattaatagaagtttgtcttcttggtcacttctctcttcagttcatcagttctgaaaactgtgttttcattcagtgctcagaggactccactcttgctttatttaatctgagatgcctccaaatataacagtatgtgtattcaagaccatacaatttgtacctgtgttgatagttagtctctgtggtttcttttaaaatgacatttgtttatttatttatttatttgagacagagtccctttctgttgcccaggctggagtgcagtggtgcgatcacggcccactgcagcctcaacctcccaagctcaagctatcttcccacctcagccccctagtagctgggactacaggcaagcactaccatgcctggctaatttttcatatttttttgtagagacggggtttcaccgtgttgcccagggtggtctcaaactcctggactcaaaggacccgcctcagcctcccaaagtgttgggattataggcgtgagccgattaacccagccaaaaaggacatttatatactattataacattcttgtagaaatactggagaatatttttatgcataagcacagttcttcttgaattgtatacatatttgaattgtatctgggactacaggcgtgtgccaccacacctggataatttttgtatttttggtagagaaggggttttgccgtgtttcccaggctggtctggaactcctgggttcaagtgatttgcccatctcagcctcccaaagtgctgggattacaggcatgagctccccggctgatacaagactattttctaatctacagactttattcaaaatttaccaattgtgaggtttttaaaacaaatctcattttgtaaaacccacctccactgagattttgctatgaattaagtaatctctatttttggacattgagaacattatcattttttgttttggtattttgagtaatgctgtgtgcatttttgtagatataggtttttaatctcctttcaaattatttctttaagatatacattcctatggagggttattggtcaaagggtatagatattttggtggctttggtaagctgaactccattcttttgagaggaagtttacacaatgtgtgaaagcagaagtattggaatgagacagaccttgtttaaagtcctgtttgtaacatttgccagctgtgtgatctctctcaagtgtcttctacttcgagtgcttctttctttatttgaaaaaatggaaattacaatttgtactccacagagttgtttgaagtttaaatgagaaaaacttatgtagtaaatttagcacattatgacaataggtattatgattttctcctctttggattgtaaattccaggagggcagggatgttgtctatctgggtccctatgttgtctctggcacctaacacagtacttggtgcaaagaaagtactgaagaaatattaatcgaatagatgaatgtcataggttataataatttatagtaccagcagtaattttaaaactatatgtgttttcttgcagtcctataagcatagcattttattaaaaaataaaacctttctgctgtctgctattttaatgtgttcttgtctaattagcattttatgtttttattatcttttttaatttttattttttgtagggggtgtctcactgtgttgcccaggctgatcttgaactcctgggttcaagcgctcctccctccttgacttcccaaagtgctgggattacaggtgtgagccacgttgcccagtgtcccccaggctggagtgcagtggcacaatctcggctcggtacaacctctgcctcctgggttcaagtgattctcctgcctcagcctcctgagtagctgggattacaggcacccaactccatgtctggctaatttttgtaatttttgtaaaggtggggtttcaccatgtcggccaggctggtcttgaactcctgacctcaattggtctgcctgccttggcttcccaaagtgctgggattacagatgtgagccaccatgcccagctattatttcttacataaattttgcatatatattggttggggcttctcttgaatgtgccagtgagaaaatacccattggttggtcgatgaaagggatggggttttcatagatgttgtatctttcctttcttagaataacatttaaacaggttcagtgacaagcaagttaaactacacattttacctttccaaaaatggggttgacctggccaaagggttgacaacacctttggatagttcccacattcttacatcattgctaagacttactaaattgataggatctttataatggtgcttttgacacttaaatgtgtatgtgaatcacctaggatgtattaaaatgaagcctgattcagtagatctggggaacacactttgagtagcaaggctatacgccagtcttaaaggtgaaaaagtgagagagatcagtagttgcattgggttgagggatcaagggagggttctttttatttcaggatgggaattacttaagtgtgtttattgatccagtgaggttataactatgctattcatttctgagtcacaagagctattcaagacatggcaaatattgcttttctgtatacgaaggacttccatgtccatcgtttgagtcagtgtttcacaaccttttttttttcattatcatccccttaaggagactttttaggtattcttatcctcattgcaacccacatcaattcttatatgacagttttaatgagatataattcacataccatacatgtcattggtttctattatttccttcaaacccacaaccatgggcaatcactcacttattttctgtctttatagatttgatttgcctatttttttttcgtttgacagagttttgcttttgtcacctaggcacgcgaccatgtctggctaatttttgtatttttagtagagacggtgtttcaccatgttggccgggctcatctcgaactcctgacctcaagtgatctgcccgcctcagcctcccaaagtgctgggattacagctgtgagccaccatgcccagcgcccctccccccccgctttttttttttgagacagagcttctctcttgtctcccaggctggaatgcaatggcatgatctcgactcactgtaacctccacctcctgggttcaagcgattctcctgcttcagcctcccgagtagctgggattacaggcacctgccaccatgcctagctaatttttgtatttttagtggagatggggttttgccatgttggcctaggctgatctcgaactcctgacttcaggtgatccacctgcctcgccctcccaaagtgctgggattacaggcatgagctactgcacccagacttttcttcttcttcgttcttctttcttctttttttcttcttcttcgtcttcgtgacagatctcactctgtcacccaagttagagtgcattgacctaaacttgtcttactgcagccttgacctctcaggctcaggtgatcctcctgcctcagcctcctgagtagctgggactacaggtttgtgccactgcacctggctaattttttattttttataaagatggtatcttaccatgctgcccaggctggtctcaaactcctgggttcaagcgaccctcccaccttggcctctgaaagtgctgggattgcagatgggagccaccacatccagcctgaattgtctgtttcatataaatggaatcaaaccacatgtgatcttttgttactgctttcttttactttttgagtgtaattaatttttattgtatatatttgtattcatttatttttaaaaacattttattttgaaatatcaaacataaaagtagagagaatagtatgatgaacttgatgtgtccatcaacccctcttcaacagttatcaatttatggccacttttgttttatctgtatacctacctattttcccttttcccattggattattttgaagcaagtctcaaataacatattacatttttgtatttacctcacaaaataagaacatagagaaaccataccacaatcctttatcacacctaaggcaatttaaaatattttcttggctgggcgtggtagcacacacctgtaatccaagcactttgggaggctgaggtgggtggatcacttgagcccaggagtttgataccagcctgggtaacatgctgaaaccccttctctacaaaaaaatagaaaaatcagccgggcatggtggtgcacacctgtggtcccagctattcaggagcctgaggtgggaggatcacttgagcctgggaggttgaggctgcagtgagtggagattgtgccgctgcactttagcctggatgacagagtgagactgtgtctcaaaaaaaaaaaaaaaaaaacaccaaaaattaactttttttcattaataatcaaataaagaataaatatgcaaatttttaaatttgaaaatcaggattcagagttcatacattgtgccagattgatatatttcttttcttttttcttttttttagatagggtctggccgtgtcactcaggctggagtgcagtggcacgatcatgactcactgcagcagtgacctccaggctcaagtgattctcccatctcagcctcctgagtagctgggactacaggctcgtgccgccatgcctggctaattttttatatatttttttgtagagacggggtttccctgtgttgcccaggctggtcttgaactcctgaactcaagtgatatacccaccttgtcctcccaaagtgttgggattacaggtgtgaaccaccatgccctgccaatatgtttcttaaatctgttttaaaaatgccacctcctttttctttctacaatttccttgttgaataaattggtagtttgacctatagagtttgccatattctacattttactgatcgcataatcatgttgtcattttacatgttcccctgtttcctatatgtttataggaaaaatatagatctggatgtttgatcagatttaggtttagggttttttttttttgaaagtgtgtgtattatattgcctgatataggaggttcataatatctggttatcttcttctattttctgtgatcttaagattcatcagtgtttgtaggggttttcagcttgatccttgcattttgaaatttcccatcagcttttctttcacctaatggtcttagcagttattgcttagatatgctatttaattatgggttgcacaatggtgatattttaattctattacaacttcattttttttttttttgcagtaaaaaaatgtttaattgatgtgaggcaggccacatggtggtggttcttcttctttttttttttttctttttgagacagagttttgttctcgttgcccaggctggagtgtgtgatctcggctcgctgcaacctccacctcccgggttcaagcggttctcctgcctcagcctctccgagtagctgggattacaggcacccaccaccatgcctggctaatttgttgtatttttagtagagacagggtttcatcatgttggccaggctggccttaagctcctgacctcaggtgatccacccaccttggcctcccaaagtgctgggattacaggtgtgatcccacagtggtgcccggccagttcttcatttttaaaactatttttttttctcttgttccttgtgttttgggtgtcatacctatgaaatcattgcttagtccaaggtcaagagatttatccctatgttttcttttaagagtattatagttttagattttgtatttaggtctgtcaaccatttcgggttaacttttgtgtagtatgaggtaaggtacaacttcattcttttgcaggtaatatgtttgtgccagcaccatttgttaaagacagtgttctctctccactgaattgttgtgacatttttttgaaaataaattgaccacaaatgtgtaggcttatttctggattcccaattctattttattgatctatatgtctatgtttatgccaagaccacatagtcatgattactgtggctgtgtagtaaggttttaaatttagaagtgtgagttctttaacattgttctttttcaagatagttttgactatttttggtccctttaatttccatatgaatttcagatcaccatgtcaacttctgccagaaagacagctgggattttgttagacattgcagttaaatccgtagaacaatttgagggaatatttccatcttaacaacattaggtgttctgatacatgaacatggaatgtctttccatttatttaggtgttctttcatttctttcaccagtgttttgtagtttccagtatacaaagtttgcattaattagttaaattcatttctaagtattatttttcagaccattgtacgtgaaacagtgttctttatttttgcattgtttattgctagtgtatagaaatacaatttgtggcccggtgcagtggctcatgcctataattccagtactttgggaggctgaggcgggcagatcacttgaggtcaggagtttgagaccaacctggccaacatggagaaaccctgtcactattaaaaatataaaaattagctgggcacggtggcacatgcctataattccagctacctgggaggctgaagcacgagaatcacttgaacctgggaggcagagggtgcagcgagctgagattctgccactgcactccagcctgagtgacagagtgagactgtctcaaaaaaagaaaaagaaatacatttgtgtttgtattgattttatattctgtaaccttgatgaacttatttattacttctaatagtttttttaaaaactggattccattagattgttttgtatacaagatcatgtcatctgcatatacaaatagttttatttcttcctttccaatctgcatgtttttcacttcttttctttgcctgtgtcctggctcaaatctctagtacagtgttgactagaactggtgaaagcagacatccttgtctccttcttgatatcatggggaaagtattcggtctttcaccattaagtatgaggttagctgttgtgtttttcatagattttctttatgaggtggaggagatttccttctgttcctagtttgttgaatgtttttataaagaaagattttggactttgtcaattacttaatctacatctggtgaaatgatcatgtggtttttctcttatattctatttatgtggtatattacattaattttcatatatatataaatatatatatatatatatttttttttttcagacagggtctcactgttgcccaggctggagtgcagtgacacaatcagggctctcactgcagccctgacctcctgggctcaagtgacccttccgccttggctccccgaatagctgggactacaagcttgtgccaccatgcctggctaattttttttttactattagtagagatggggtttcaccatgttgcccaggccagtcttgaactcctgagctcaagggatcctcctgccttggcctcccagaatgttgggattacaggcgtgagccactgcgcccagaattttttgtatgttggagcaacattgcattattggcataaattccactttgtcattatgtagagtcctttttatatatttctggaatcagtttgctgtttgttgttgttgaaggtgttgttttaatatttataacagacttttgtatttagacttattttcttgtggttagtttaatttttatattagggtaatactggccttacagactgagttgggaagtttttgtatgttgtgtctttattttgcatttatctgaaaatattttctaatttgtcttgtgatttattgttttacccatttactgcttagtagcatgttgttcatcttccatatctttgtaaatttcttaacatttctgttattaatttctaattttattcctgtggccataaaacatacttcttatgatttcagttctttcaaatttattgatggttgtttaatgaagtagcatataatctatcctggataattttattagtgcacgtgagaagaatgtgtattctgctattgttgggtgaagtgttctatagatgtttgttaagtcttgttagcttttcatatttttgaagtcttatatttctgaagtattgattttctatctagatctaaccattattgaaagtgagttactggctgggcgtggtggctcacgcctgtaatcccagcactttgggaagagccgaggtgggcggataacttgagctcaggagttcaagaccagcctgggcaacacagtgagactctgtctctaaaaaaaataaataaataaaaaaaaagaaagtgaatcgttgaattcttcaatgtctattgttggattgtctatttttccattcaattttgtcattgtttattttatgtattatgtattttgggctctgatgctctgatgttatgtgcatacatgtttataattgttatatcttcttgatggattgactcgtatcattataaaatatctctcctgatttccattgtcttttttttttttttttggtttggagtgtattttgtcctattctaatatagccactccaggtttctgatctttttcatacttagcttttaacatatttgtgtctttgaatgtgagatgtgtctcctgtagactgcatatagttgtctctttaaaaaaaatttagctggttgtgggggctcatgcctgtaatcctagcaactcaggaagctaaggcaggaggatcatttggggtcaatattttgaggcctgcctgggcaacgtagaccttgtctttagaaaaaaaaccaaaaattaagttttgcacttaaacaaatttatattgtttaatgtatttctgttgaatgttactattgacataggtggatttacatctgccattgtggtttaaaaatttgtctcatgctttttcgttgctatattcctccttaactgctttattttgcattcggtgctgttattgttatacatattttatctataatatttaaaaatcgaacaatacgtttttataataattatcctagaggtttttgtaacttttaaagaagttgatgcgtaagaatgggaaaaaaattgaaaaagacaaaaatgaacatacagaaacaattttttaaaaaagttgaaggaagggaacaagtgtacctttatagcatttgttatagtaacatttttgggtgcaatttctggttcttttcatttgtttttgtgggttcatgttaccattttgtgtcattttcttacttcttttttttgggacagagtctcactctgtcacccaggctggagtgcagtggtgtgatcttgactcaccacaacctctccctcccgggttcaagcaattctcctgcatcagcctcccgagtagctggaattatagatgcgtaccaccatgcctagctaatgttttctttttgtatttttggtagagatggggtttcaccatgttggccaggctggtctcaaactcctgacctcaagtgatcctcccacctcggtctcccaaagtactgggattacaggcatgagccaccacgcctggcccataatagctttgctttaatccacttctgtgatcatattggaaaataaatttttttagccatgggccccgaaatacacacacacacacacacacacactctcacacacacacacacacgtacacacatagagtttaatataattgccttttacatcggttaagagaagaaagaagaagatacatatgtttatactgtctttttcctttttattttttgagactcggtcttgccctgttgcccaggctggagtatgatggtgtgatcttcgcttactgcaaccttgatctcccaggatcaagacaatcctcctacctcagcttcccaagtagctgggactacaggtgtgtaccaccacacccagctaattttttaaattaattaattaattaattttattattttatttttttgtagagatggggtctcagtctgttgcccaggttggtcttaaactcctgggctcaagcaatccttttgcctcggcctcccaaagtgttgggattacaggcgtgaacactgttcctggcctatactgtcttttataattataaaatttcctttacaagacatctcagtttaaaaaaattaattaattacttttttagcaagcatttctgtgaaagagagatctcagttttttatgtgaatttgaattactctctgtggtcaactgctttgagattcaagaagtccttcagtatttcttgtgagtccactagcagaggactctctcactagaatctgggtctcaacttatacaatgaaaatcagcatctttgagggtggagcctaggcaacggtagtttaaaaaattgtaccatgttattatttttatttttttgaggcggagtctactcttttgcccaagctaaagtgcagagacatgatctctgctcattgcagcctccacctctcgggttcaagtgattcttctgcctcagcctcccaagtagattggactacaggtgcacgccacccgtgcccagctaatttttatatttttagtagagatggggtttcaccatgtttgccaggctggtctctaactcctgacctcaagtgatccacctgccttggcctcccaaagtgctgattttacaggcgtgagccaccgtgcccagcaaattctgataataaaccaaggactataaccacagggttagatgatttccaaggtctcatgtagctctcacatcgtgtgacactgtggatagatttcgtagttcatgttagaccacaccttcgtagcatatcagtctgacagaggcctgtggttctcaaagtttgtccctagaaaaacagcatcagcatctcctggtaaaatgttaacattgcaaattctcaggcaccactctacgtggaatgaatcagcaatggacattcctgcaaaggacacagcagtatgtgtattaacaaactctatctctccatgtgattctattgcactgtgaagtttgagaaccactggcatagagaaagagaactgtgggctttggggtccgaggacttctcattagtcttggagaggtatgtataaatgaccagttattttgggcacctaacgtatcttcgttgagcacccccccgcttttttttttttaaggagaggaagaatatttgcattttcttaactcacatggttgttgtgaggctagagcgcttatgtcaaagcccctttgtaaactgcgaagcatgtaggcacacacaaggagtcattgtgagcaagggaagtacaattcattaagcatctcttctgggacaggaactattaattaattaattaattaattaattgagacagggtcttattctgtcgcccaagctggagtgcaatggtgcaatcttggctcactgcaacctctgcatcctgggctcagataatcctcctgcctcagcctcccaagtagctgggactacaggcatgcaccaccatgcctggctaatttttgtattttttgtagagatggggtttcaccatgttgcccaagctggtctcaaactcccggactcaagggatccttccaccttggcctcccaaagtgctgggattacaggtctgaggcactgcacccagccaggaatttcatatttattattttatttaattcataaccactctacatgtagtgaaataattatttagaaatccaatttagtttttgaattgtattggaatttatacattgaaattcaacatcaatccagctgcatcaaagtctaactatatggaaattcatcgatatcaaaatgtaagtacacaaagatcaaactgcatcaaaatccacaggagagctaggagaaaaattgtgtatattaaaatactaagagcattttgttgcattctcccacctcctcaccaacaaaagctcaaaatcttgtcctgtcatatcagtagctaaagcatgttaacacttagctcttacactaaactagttacttctttgacttaggggaagtcatacttccttactggattgtactttaatctttctattttaaaattagtggttttacagaaataaaatctttaaaatataattcttaccttagtctatttaaaacatgctgttacagctcagcatggtggctcatgcctgtaatccctgcaccttgggaggctcaggtgggcagatcacttgaggctgggagtttgagaccagcctggacaacatggcgaaaacccatctctactaaaaatacaaaaattaaatgggtgtggtagcgcatgcctgtagtcccagcttcttgggaggccgaggcatgagaatcgcttgatcccgggaggcagaggttgcagtgagccgagatgatgcactgcattccagcgtggggacagagagagactctggctcccccaacccaaaaaaaaaaaaaaaaattcatttgaaattagagaaaacttccctgccaacattggtccttaagagtgtgattaggagctctcagaagtcacgggttttattctgaaattaataacacttgcttcccaatagagaggtactcactgtgcatgagaatattttgatgttttgtcacagccatttcatatatggaggtgcgtgtgtgtgtgtgtgtgtgtgtctgtgtgtgtgtgtgtgcacgcacgcgcgctttattatttatttatttattttgagacggagtttcactcttgttgcccaggctggagtgcaatagtgcgatttcagctcacagcaacctccgcctcccgggttcaagtgattctcctgcctcagcctcctgagtagctgggattacaggcatgtgccaccatgcccagctaattctgtatttttagtagagacgggttttcgccatgttgtccaggctggtctcaaactcccggcctcaggtgatctgcctgctcggcctctcaaagtgctgggattacaggcgtgagccaccgtgcccggccgcatgtgtgtgtgctttaaaccactaatcttattggatgaatattattacattatatgacatttgcatgcattctattattattattattattattatttgtagagatgggggtctcactatgtatcccaggctggtctcaaactcctggcctaaggtgatcttcctgcctgtactaagattacaggcatgaaccaccacgcctggcctttttttaaaaaaataagtatttatttatttttgcatgcattttatggccaccgttatatatactatggcttaacaggggctagaatgtgaacttgaagttttagtgtttcggttcctttctctgtaaatttgaatgaggctagctagtgatggagtggtcagtttctgaagaatattgttatcttggcactaaagaaacaaattagctcccattttctattattcctgcatccaggcagcagaatctgtttgctttatttactgaagattcgtgtacaggcacagtagcagcctgtgttcctatggtttgaaggctttaagctctttgctgttttttttttttaatttccataaattatcatttagaggtaatagaaatggttgggaggttataaagattttccccctatcgttttttggcccagaaatctcctgctttgttctctcaaaggctgagtctttagcagaggctctgccaaaaagaactggagttttcccttgggaatcagaggaaaggctcagtattcagcaaatttgaaaaaggcaagcttttcagatgttaataagtctaaacaggacccaggaagctctgcagtctccaaggcagattaaatacccaagtggtataacctttccctcggctgtggccaggttcttaactattggtgataactttaagaacggatcacaaaggtggaattctcccaaaagtcatcactctgaacttggaatccaatacaagcttcaaaagtcacagcaagcaataagcactggcaacaccaggcgcctatttgggtgccagattttcacattttctttgggtttctcaccatgtctctaaccccagctgctagtgaatgcttaactgccagttgctgccacaaacgtcatgttggaaatgaaaaaaaaagttctctgccttggaaagagcacaggagacacagcaaaaagctagttattttcatcatcatcattattaatgcaaatttaaaagcacagagtcataaaatagacactgtgtacacatgtcctcaagataaacattctgtcatgtttgcttcagatcgttctcattcttttttcttatttatttatttatttatttatttatgagacagagtctcactgtgtcaccaggctggagtgcaatggtgcgatctcggctcaccacaacctctgcctctcaggttcaagtgattctcctgcctcagcctccccagtagctgggactacaggcatgcaccaccacaccaagctaatttttttgtagttttagtagagacagagtttcaccatgttggccagattggtctcgatctcttgacctcgtgatccacctgcctcagcctcccaaagtgctgggattacaggcaggagccactgcacccggcctctttttttttttttttttttttgatacagagtctagctctgtcacccaggctggaatgcagtggtgcgatcttggctcactgcaacctgtgtctggtggattcaagtgattcatgtgtttcagcttcccaggtagttgggattacaggtgcctgccaccatacccagctgattttgtttttttagtagagactgggttacaccgtattggccaggctggtctcgaacttctagcctcaagctatccacccacctcggcctcccaaagtgctgagattactggcttgagccaccgcacctggcccagatcgatctcattttctaagtaaaacatagagatagtgaaatctgcgtttacctctttccccagtccttattactttctctcaccaagggcagccacaatgctgaatttggtatttatccttcttggcaatgttttctgtttatatataatattataatcattatgtaatataattatatattaatacatatatctactaatatataattaatacaatacattataattataagatataactattatataattatgtactatattgtatataatcatatataaattatacaagtacaatataattttacataaattatataaacataactatataaattatatatataattttatgtacattatataagtatacttttacagaattatacatcttatgtatattatatatgagatatatattagatatatactagatgtatacatttgttgtttgtgtctatatatatggaatagaaaacatggccaagaagaatgcatgccaaatatatatttaaatatattaatatgtaatatatttaataaatctatatttaatagttatattaaatattttagttatataaatatataaatgcttatatttatagatactatgaatattatatagagatataaatatatatttgtgctggaaatgttttgtatatttaaattttttttacaagtggaatcatactatatgtacttcaacttgtttttttttccacttagcattgttctttttcgaattttagatattttcatgttgatatacagtatatagatataattcattcttcactttttttttaaagaggcagagtctcactatgttgcccaggttgggctcgaacgcctgggctcaaatgatcctcctgcctcagcctcccaagtagctggaactaaaggcacttgttgccatgctgggattcattaacttataatactcactaggacacttctgttatgaatattgttgggaaaattaaaaattaaatctcttgctaacttagaaaatccttttcacaaatgtggaaaagaaagaaaactggccgagcgctgtgctcatgcctgtaatcccagcactttgggaggctgaggcaggcagatcacctgaggtcaggaggtcgaggccaacctggccaacatggtgaaaccctgtctgtacaaaaatacaaaaattagctgggcatgatggtgggtgcctgtaatcctactactcgggaggctgaggcgggagaatcgcttgaacccaggaggtggaggttgctgtgagccgagatcttgctgttgcactccagcctgggcgacagagtgaaactctgtctcaaaaaaaggaagaaaaaaaaaaagaaaaagaagaaaggaaaagaaagaaaaccattgtgttactgaaagcattaaatcagacggggatgtgaatgacaggtaatacactaatgagactgtaagcatagaaagaaatgtcacacttttacataggcaagaatatatgatccatttacatatgtgttctcaatataaagcataacttgccctccagttagatttgacagcacttttattttacatagttcaggcaatattcaccttgtagttgaggtggccatatgttagctaattgcctttatccaaagaaaaaaatataacttctcttgtctatatgcccagcaggcatttaagatttaaagcaaggtacctaagctaaactccctgaggtaacaaggagatagaggtatatttatcttgatgttaatgtttcaaagagatggatccccaggtccttaagaaaaatattaggtggtcatgctggcaagaggcttatttagctctttagaacatttgcatagttatagaaaagatagaaggtggctttgtaataaccttttcttgaggaaatgctctaagaaaaggaagaatggaaaagccttttcctattcagcaactgggaacattcaatcctactatatactacatatttatttattcatttacttataaatgggcatgtaggctatttctaatatttcattatttcccataatatgccaatgaacatccttatctatgccttcctgggcagtgtgcaagagttactcagattatgagcattgttaatactacagatatttccaaattgtattcctgagtgcttatacacatttatacttacaccaacaaatataagactatccactttatccatttgttcacatcattaagatttgaggctgggtacagtggctcatacctgtaatccctgcactttgggaggctgaggtgggtggatcacttgaggtcaggagttcaaggccagcctggccaacatggcgaaactccgtctctactgaaaatacaaaaattagcggggcgtggtggtgggcgcctgtaatcccagtcacttgggaggctgaggcaggagaatcacttgaacccaggaggcggagagtgcagtgaactgagatcgcatcattgcactccagcctgggcaacaagagcgagactccatctcaaaaaataaaaagatttgaaatggccagaccttaaacattttgccaatctgacggatgtgaaatggtatctcattattccttaatttttgttttcctaactactaattgagtatgttacaatgtgtttattagccattcatattttcttttttgtgacgtgcttatttttgtagtatttgcccatttttcttttgggtttttggtcttcattattgatttataagagtcctttctatattttagaagttagtattttatttgttatatatgttacaaataatttcccctattcctagtattccccattgccaaagtcaactatactgttaatttttatcctcctttcattttatttcctgtattttttgtcatgcagaagtttttaactgttaaaatatatttattttcctttattacttgtactttttgcatcttatttaagaaattctttcctatgctgaagttagagatgttttcttgtgttcttttaaaagtttaaaagttttggctgggcgcggtggctcacgcctgcagtcccagcacttcgggaggccgaggtgggcggatcacgaggtcaggagatcgagaccatcttggctaacatggtgaaaccctgtctctactaaaaatacaaaaaattagccgggcgtggtggcaggcgcctgtagtcccagctactctggaggctgaggcaggagaatagcgtgaacccgggaggcggagcttgcagtgagccgagatcgcgccactgcactccagcctgggcgacagagcgggactccgtctcaaaaaaaaaaaaaagtttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgcccctgcagtccgcagtctggcctgggcgacagagcgagactccgtctcaaaaaaaaaaaaaaagtttaaaattttttttttttttttttttattttttttattttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttaagattagggagtggtgatgactctcaacgagcatgctgccctcaagcatctgttcaacaaagcacatcttgcaccgcccttaatccatctaaccctgagtggacacagcacatgtctcagagagcacagggttggggataaggtcacagatcaacaggatcccaaggcagaagaatttttcttagtacagaacaaaatgaaaagtctcccatgtctacttctatccacacagacccagcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagtgcccctcacctcccagatggggcggctggccgggcggggggctgacccccccaccgccctcccggacgggcggctggccaggcagaggggctcctcacttcccagtaggggcggccgggcagaggcgcccctcacctcctggatagggcggctggccgggcgggggctgttccccccacctccctcccggacggggcggctggccaggcagaggggtcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagaggggtcctcacttcccagtaggggcggccgggcagaggccccctcacctccggacggggcgcctggccaggcaggggctgatccccccaccgtccttcccggacggggtggctgccgggcggagacgctcctcacttcccagacggggtggttgccagacggagggctcctcacttctcagacgggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagacgggatggcggccgggcagagacgctcctcactttccacactgggcagccaggcagaggggctcctcatatcccagacgatgggtggccaagcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaacgaaaaccagtcaggcgtggcggcgcgcgcctgcaatcgcaggcactcagcaggctgaggcaggagaatcaggcagggaggttgcagtgagccgagatggcagcagtaccgtccagctttggctcggcatgagagggagatggacacgggagatggacacggagactggagatggatatggagacgggagatggatatggacactggacatggacacgggacatggacaaggatacgggaaaaggagaaggataccggacacggaaaaggacaccggacaaggatatggataatggaaaaggaaatggaaaacggaaaaggaaaaggaaaacggaaacggataaggaaaacgggaaaggaaaagggaaacggaaagggaaacggaaacgggagagggaaacgggagagggagagggagacgggagagggagagggagactgtggtctttatccaaaagtttaaaaattttgcttttcacatttagattataatccatgtagttttatttttgtgtatggtatgagatagacatctagatttgtatatagatggccaattaatccaacatattttatgtaataatattcacttttttcaatagtttgtgatgtttcctgtgtcatatcataattttttatatatatgtgcatctatatcagagatttccatttctggtccacctggctatttgtctatcccggcaactagactgtcttgattattgtagcttgtaagaagtctagcttattggagagtctgattaaattgttttccagtactttcttaactgtttttagattggcacttctctattgaatgactgagttcatcaagttccattaaaaaaaaacctacagattagaattgcatgactttatagattgattgagagaacagaccccatgagttttctcatgtatgaatatgggtaattgtttcaactatcaggggtcatttgtatctttcaatattgtttaatttttttaagagacagtgctttgctctgttgccccaacttgagtgaagtggcatgatcatagctcactgcagccttgacctcccaagctcaagtgatcctccgacctcagcctcccgcgtagctgggactgcaagtgcactccaccatgcccatcaaatttttttttttttttttacttttgtggatatggggtctccttatgttgcccaggctggtgtcaaactcctgggctcaagcaatcctcccaccttggcctcccaaagtgttgggattacaggcgtgagccactgcacccagtctgtctaaaatttttaatatgaaattcatgcacattttttcttaaattcattttaaggtaatttacatgtttagttgctatgatgaacccctttaaagtattttctaattattatttatttttatttttagatttttttttttttttgagaaaaggtatcactgtgtcgcccaggttggagtgcagtagcatgaacacatctgacactgcagccttgaactcccaggctcaagtgatcctcctcccacgtcagcctctggagtagctgggactacagcgcgcaccaccatacctggctatttttttttttttttaatttttgtagagacggagtcttaccggtttgcccaggctcatcttgaactcctgggctcaaatgatcctcttgcctgggtctcccaagttgctgggattaaaggcaagagccaccatgcccagcctaattgtttattttgaacatttggaattcaattgattttcatattgttgatcttgtatccagtaactttgatgaactgtcattatttctaatggtttgcctgtaggtttgtttgtattttcttactggtaatatcatgtcacctataaatatttattacttcatggctttctttctaacctttacactttatctaacttttccatgtccaaatgcattggctagcatggccatacagtttctattagtaagagctatagggacactctggacttcatctgtgctttaataggaatgcttctacaatttcaccattaaatttgatgtttgatgtaagcttttaatagatagtggtcatcaggttaatgaagttctttctagtctgaggatgcctttttttgtaatgatcctcatggatgagtactgcattttaatcaaatgctttttattgtcagtctgtatgtatgataaattacaataataggttttctaatgttcaattatccttaaagtcttaaaccatacgtaatcatgatgtatagtcaatttcttatatgttgcttattcaccaaaattctgtttaggatttttgcatttatcttcatgaatgagattggtctataatttttttcttgtacattttatcatttactcattcaacaagtatttattgagtccatactgtgttctgtgtactgttctagtgaatgttgatatagtagtgaataaaatagataaaaatctttgccctcatgaaacttatattctactatggggaagacagaccataaacaagacaatttattaaatatgtagtatattagatgttgacaaatgctaacgatacaaataagcagaaattaggatacatagtgtgtgtgtgtaggggggtatgcaatctcagaaaagaatttacagcaacagctctcttacaaggtgacattttaggaaagacatgtgagggaagagaaagtataatggctctgaagtaagcatgtttctggtaggttcaagaaagagaaaggaagccattgtagctagactgttttactatcagaccaataagtaaattgggtagctttccctctctttaaaaaatgtaattgtatcttacataattatactgtaatataaaaaccaggaaactgacaatggtacaatgtatatgtatcgttctatgcattttatcaagctgtgtagatttgcatgactttaaccttagttaatatacataacgatttcatcaacacaaatatcttccttcatgctacccctttatattcacgcccacacacttccttgccaccacatgtatcctctggcaactaagaacatgctctccatttctatatttttgtcattttgagagtattatataagtggaatcatacagtatgtgaccttttaagatttttttttcttttttctcagcataattttctggtgattcttgcaagttattgcatatgtcaataattgatttatttgtattggtattgagtggtgcaactttctgttttgttttattttgtttcgagacagggtctcactctttcaaccaggctggagtgcaatggtgcgatcttggctcactgcaacctccgtctcccggattcaagcgattcttctgactcagtctcccaagtagctgggattacacgcacacaccaccactcctggctaatttttatatgtttagtggagacggggtttcatcatgttgaccagactagtctcgaactcctggcctcaagtgatcgtcttgcctcaaccccccaaaatgctgggattacaagcatgagccaccgtgcccagctaagtggtgcaactattgaatagtattccatggcatggatgtatcatagcttgtttaactattcaccttttgagggacattttagtcatttccattttttggctattacagatgaagctgttatgaatattcctgtagaggattttgtgcagtcatatgttttgttttctctgggataaatgcctgggaacgtaattgctgggttgtatgataagtgttttaaaagaaactgagggccaggtacagtgacccatgtctgtaatcccagcactttgggagtctgaggtgggcagattgcatgaatccaggagtttgagaccagtctgggcaacatggcgaaaccccatctctacaaaaagtacaaaaaattagctgggtccagtgatgtacacatgtagtcccaactactgtggagtctgaggtgggaggataacctgagccaggtagttgaggctgcagtgagccatgatggcgccactgcactccagcctgggtgacagagtgagaccctgtctgaaaaataaaataaaataaaataaaaacaaactcttagaatgtaaaatatgtttggtcttttttttttctttattttgagacagagtcagggtggagtgcaatggtgcgatattgggtcactgcaacctccacctcccaggttcaagcgattcacctgcctcaacctcctgagtagctggaattataggcgcccaccaccatgcccagctaatttttatatttgtagtggagaaggggtttcaccatgttggccaggctagtctcaaactcctgacctcaggtgatccacctgccttggcctcccaaagtgctgggattacaggcatgagccaccgtgttatgcccagcctgttatgtcattcttatgcctttgagtcctcatagcttagctcccacttgtaagtgagaacatacgacatttgggttttccattcctgtcactcatactttgggtagaatggaagcctgcaaacctgtgtggcttcatgctgggagactttcatgtaatatgatggactggactaattattaatgattgaatgggattctagtaatgtgccagtatcttttgaattctgtatccttctgatgtaaggccagcagggttctaaggggtagagagtagggacttgtgatattgcaaaatatgtattcggtctttgagcaggtttcctgacatacaactcctaaaatcattcgaatcttgtaagtgatgtctttttgtatgctaataatggacccatgcctggcaccttctaggtagcgtcacgatagggggtggtcaccataaagactaaggcaggaatagagggttgggacttgagtcccactcccaacctccagggagggaagaggggctgaaggttaagttggtcaccaataatcaatggtttaatcaatcatggctacacaatgaagcttccataaaggcctaaagaactgggtttgtagagcttccagatagatgaacacatgaaggttcccagagggtggtatgcccaagtagggaagggaagccctgttcctctttccacatgccttgctctatgtatctcttcacctgtatcctttgtaatatcttttataataaatcagtaaacataaggggtttcctgagtttggtgagccgctctatcaaattaatagaacacaaagagggggtaatgggtaccccaacttgaatctggtcagtgagatgttccagagacctggacttgggtctggtgtctgaattggggtagtgttgtggtaccgagcccccagcctgtgggatctgatgctatctccaggtagatagtgtcataattgaattggatgatgcccagctggtgtccactgcaaaattgattgcttatttggggtatgggggaaaattcccaaccatttggtcacagaagtcatgcatgttgattgttgctgtgttgtgagaatatagaaaaatgggggggggttcattcatagaaactgtcaaagtgttttctagagaggtttcacaattttacatttgcaacaatgtaataagaaattcagtttttctgtatcctcaccagcatttggtattgtcactgttttttgttttagcctttctgatagctctgtggtaatatctcaatatctctttgtatttatatatatttttttgagacggaggcttactctgtcgcccaggctggagtgcagtggcgtgatcacagctcactgcaacctctgcctcatgggttcaagcgattctcctgcctcagcctcctgagtagctgggattacaggcgcccaacaccatgcctggctaattttgtatttttaatatagatggagttttgccatgttggccaggctggtctcgaactcctgacctcaagtgatccacccatctcagcctctcaaagtgctgggattacaggtgtgagccactgtgcccggcttctctttctattctttatgtttactgatcagctatttatgttgactattgtttcttatgcttatttgccatccacatatcctctgcagttaaatatttttttatatctgttgcccgttttctgtttggattgttatcaattttcaactttgagtattctttatatgtataaagaattttatatatgagtcctttgtgagatatgtggtttgtgaatactttctctcaatctacaacttgtcttttcatcctaacaggtcttttgtagagcaaaattgtaaaattttgttggagtttaggttgtagatttatttatttatttattttctttggagagcaagtctcattctggtctctcaggctgcagtgaaatggctagatcccggctcactgcaacctccacctcccaggctcgagcaatcctcccacctcagcctctcgagtagctgggactacaggtgagcgccaccacactcagccaatttttgcatttttcatagagatggggccttactgtgttgtccatgctggtcttgaactcctgtgctcaagtgatccacctgcctcggcctcccaaagtgctgggattacaggcatgagccaccatgcccagtcattttttttttcttttataggtcatgattttggtattatgtctaagaactcttcgtcaaggcctaggatctaaagattttcttcaaactttctcctaaaaattctgttgtttaatgtttaagtctgtgatgcattttgagataatttttgaataaggtatgaggtttaagttgaggttcatttttatgtctcatgttcagtggctccagggccatttattggaaaagtaatatttcctccattcaattgcttttgtacctttgataaaaatcacttgggtaataatttgtgtagatattccatttcaccctcaggagggcataaatgtggactgcacatggtgattttcttcctaagatgcagtatggaaaggaggaaagaaagagtaatttgagagtggagaaacctgacactgcgttatccaggtgatcaaggtcaacatcaatagtgataaatcatgttgatagtgtatacctgtggtatgatgtatgacagtggcactttatctcagtggtatttctccccaaaatttataatcccagtgtaatcatgataaaaacttaagacagatcttaattgagagacattctccaaaatacctgagcagtacttctcaaaaccggcaaggtcatcaagaacaaggaaagtctgagaaactaccagagctaaaaggagcctaaggagtcatgatgactaaacgtaatgtgggatcttggatgggatttggaaaagtaaaaagaccttaggtaaaaaccaaggaaatctgattaaagtatggactttaataatgtatcaatattcactagttgtgacacatgtaccatactattatacactgctaataacagaagaattgggtgtagtgtatatgggaactgtactctctttgaaattcttcaataaatctaaatcattctaaagtttatttaaaataatcagtggggctgggtactgtggctcatgcctttaatcccagcactttgattttttaaaaaggagctattttagttcctttatgtttccatatacattttagaattattttgtctgtctttgccccaaaaaaatcttgctgtggttttgataggaattgcctgaaacctgtatatcaatttggggagaattgacatttttattatgttgagtcttataatacataaacatggtaagcttctccatatatttagactttgatttcttttgtctgtgttttgttttcggtatacaattcttgaataggtttagttagaattacatgtacttgttttttgggggggttcattgtaaatggtattgtgttttttatttcagtttctacttgttaattgctagtatatacaaatacgattgatttttgtatgttgattttgtatggggcagctttgctgaactgatttattagttctaggaattttgtggcagattgcttggtgttgttttacagactatcagtcatctgaaatacagacgctttgaaatagagacacttttgatacgttgtaactttagttcaatgtatagttttttgtttgtttgtttttttacttgagatggggattcaaagtgttgggattacaggtgtgagccaccttgcctggcctcagtgtgttgttaattttccttgagatttcctctttgacctataggtttaggaatgtgttagtttccatgtgtttggaaattttcctgatttcttactgctactgatcttttcttttttcttttcttttcttttcttttctttctttctctttccctccctctctcccttcctcctcctcctccttcctccttctcttcttcttcttctttttcttttcttttctccttccctcactccctcctttcttttttctttctctctctttctttctttctctttctttctttctttctttctttctttctttctttttttctttctttctttctttctctctctctttccctccctctctccctccctctctcccttcctcctcctcctcctcttcttcttcttctctttttcttttcttttcccctcgctccttccttccttccttccttccttccttccttccttccttccttcctttctttctttctttctttctttctttctttctttctttcctctctttctttcttcttcttctttttctttttttttttgagacagattttcactctgttgcccaggctgcagagcattgtcaccatcagggttcactgcagcctcgacctcctgggctcaggcagtcctcccatctcagcctcctgagtagctgggattacaggcatgcattaccacgccaggctaatttcatgtattttttgtagagatggggctttgtaatgttgcccaggcctttctcgagctcctgggctcaagcaatccacatgcctcagcctccccaagcactgggattacaggcttgtgccaccgtgcccagcctgttactgatttctagtttgatttcattctgaccacagaatattccctgtggaattgaaaataaaaaaactttttttgaggttggttttatggctcagaatatggctgtggtaggcagaataatagcccttcaaaggtgtccacattctactcacttaaatttataaatgttatattgcatggcaaaagggaattaaggttgcaagtgtaatgaggtttgctgatggcctaattttgagatgtgagcatatcttggattagccaattgtgcccagtgttttcataacggtctttatacattgaagagggaggcaggaaagagagaaccagagtggtggaggtgtcataaggacttgatctgacattgctgatgtagaagatggagaaatctttggtcaggaaccaagtaatgtgcgtggctgggaaaggcaaagaaagagagtctcactaaaagcctccagaaggaacacagacctgctgacactgattgtagctcagtgaggcccattttgaggtttgacttcaagaactgtaagacaatacatttgtattgttttaaaccaccaagtttatggtaatttcttatggcagcgaatagaaaactaatataatggtctatatcagtaatatatcatggacgcttgaaaagaatgtctattctgctaattttggttggggtgttctataaattttgattagatcctgtagaccgatggtgttgcttagttgttctataaccttgctgtctagttttatacattgttgaaagaggactgttgaggtctcctattgtaattgtggatttgtctcttcttatggttctgtcagtctttgctttatgtgttttgaacatctgttgttttgtgcatacacatttaggaatgctatatcttcttggtggattggcacttttaacattatgtaatgcccctctgtatccctattaatttatttgctctgatgtctactttatctgatattaatataaccactcctgttttttttaatttttagttatttatttagagaccagattatgagactgtcattataataatattaagtcttctaatccatgaacacagatgtctttgcatatatttctgtctttaatttctttcattaatgctttgtagttttcattgtacaagtcttttgtctccttggttaaatttattcctatgtattttattctttgagacgctactgtaaatggaattatattcttaatttttctaattgttaattttttagtgtatagaaatgcaactgttttttttgtgttggttttgtgtcctgtaacttctaaattcatttattaggtctaataatattttttgtgaattttagggattttctgcatgttaagttcatgtcattggcaaatagagataattttacttcttcctttacaatttaagtttacattttattttctttacttgttaaattgctgtggctagaacttccaatactgtgttgaatagaagtggtaaagcttctagactttaataattgagtatgatattagctgtgtgtttttcatatatgacctttatcatgttgaggtagcaatcttctattcatagtttattgtttgttttaatatgaaatgtgttgaatttcatcaaatgaaatgtgtagaatgacttcgcataaatcgagatgagtatgtttctttcttactttctgtctttctctctctctctgtcccttcctccctccctacctccttctcccccctctttctttctttcttccctttcttccttttcttccctttcttttctgtcttctgactgggtctcactctgtcacctagatcaccaaggctggagtgcagtggtgtgatcatagctccctgcaggctcgaactccttggctcaattgatccttctgcttcagtctcccaagtagctgggaagatgcacgtgaccatgacaggcttccctttgtttttattaaacgatgtataatatcgactgattctctctctgtgtctctttctctctctgttttttttttttttttgagatggagtcttgctctgtcgcccaggctggagtgcagtgacacgatcttggctcactgcaacctccacctcctgggttcaagcggttctcctgcctcagcctcctgagtagctgggactatatgcatgtgccaccatgcccagctaatttttgtatttttagtagagacagggattcaccattttgcttaggctggtcttgaactcctgacttcaggtgatccgcctgccttggcctcccaaagtgctggggttacaagtgtgagccaccatacctggccaagatgttcgtttttttttgtagtgtttttctctagctttggtatctgaatattttagaagggtttgagaagtattggtgttattgttttttaaatttttggtagaattcaacagtgaaaccacctggtccagggcttttatttttatttttattttttttggttgggaggattttttttttgaaatggagtttcgctcttgttgcctaggctggagtgcaatagcacgatctcggctcactgcaacttccacctcctggtttccagcaattcttctgcctcagcctcccaagtagctgggattacaggcatgcgctaccacgcccggctaattttgtatttttagtagagatggggtttcaccttgttggtcaggctggtctcgaactcctgacctcaagtgatccacccgcctcagcctcccaaagtgctgggattgcaggcatgagccactgtgcctggcccggttgggaggattttgattactgattcaatctcctaatggcattcatttattcagtttttctgtttctttgttattcagtttttgtaggttgtgtgttacaaggaatttgtccttttgatctaggcaatccaattggttggcatgcaattgtttatagtattctcttataatcctattgattcatgtaaaattggtagtaatgtcctctcatttatttctttttaaaaaaatttaatttttttaatttttgtgggtacataataggtatatatacttatggggtacatgagatattttgatacaggcatacaatggttaataatcacatcagggtaaatgaggtattcaatcatgtcaagcatttatcatttatttgtactgtaaaccaattatactcttttagttattttaaaatatacaataaattgttgttgactatagttacactgttgtgctattcagtactagattttattcattctaactatatcgttgtacccattaaccattcttactctcttccctcactccccactacccttgtcagcttctggtaatcatccttcaactctccatcttcatgagttcaattgttttaatttttagctcccaccaataagtgagaacatgtgaaatttgtctttctgtgcctggcttatttcacttaacacaatctccagttccatccattgttgttggaaatgacaggatttcattcttttttatggttgaatggagtactattcagccataaaaaaagaatgattagatctcatttgtggtatttgtgaatgacgtggtatatgtaccactttttctttatccattcatctgttgatggacacttagagtgctataagaaacatgggagtgtagatatctattcggtatgctgatttcctttcttttgggtatatacctagcagtgggattgcaggatcatacggcagctcaatttttagtttattaaggaagctccaaactgttctacatagtggttgtactaatttacattcccaccaacagtgtacgagggttcccctttttccacatactcgccagcatttattattgcctgccttttggataaaagccttcctttcctttctttcttatttatttatttatttatttgagatagggttttgctttgtcatccagcccacaatgcagttgtaggatcatcacgcactgcaacatcgagctcctgggctcacgtaatactcctgccttagcctcccaagtagctgggactacaggcatgtaccaccacacccagctaatttttattttttggtggatatgagtctcactctgttgcccagattggtcttgagctccttgactcaagtaatcctcctgccttggcctctctaaatgttgggattataagcatgagccaccgtgctcggtccctaattttattcctgattttaataatttgtgtcatctctattttttcctattcagtctagctaaaagtttgtcaattttgttgatctctttaatcttttggcttcattgattttccttattgtttttctattgtctattttattgatctggggactattttttattttctttcttctactatcttatgtttagttttctctttttcaagtttcttaaggtgtaaagttagattactgattcaagatatttcttcatttttaatgtaagcatttacagctataaatctccctttcagcactgcttttactgcatgccatacgtcttgaaaattatgttgtgtttttggtttcatttatctcaagatacttgctattttatcttgtgatttcttctttgacttattggttgtttaagagtgagttattggccgggagcacaggttcacacctgtaatcccagcattttggaaggccgaggcatgtgggattgcttgagctcaagagtttcagaccagtctgggcaacatagtgggaacccgtctctacaaaaaaaaaaaaaaaaaaaaaaaattagccgagcctagtggtacatgccagtagtcccagctacttgggaggctgaggtgggaggattgcttgaggctgcagtgagctgagattgtgccagtatactccagctggggcaacagaatgagaccctgtctcaaaaaaaaaaaaaaaaatagaatataatttcatgtgtttgtgaattttcctgttttcttatattattaatttctagtttaatttcatttttatcagaaaaaatattttgcatgactttaagcttttaaaatgtattaacatttgttttgtggcctaacatgttgtctgtcctggagaaattttcatgtgcatttcaaaaaatgtgtgttttattgttgtgggatggagtatcctttatatatctgtttgttccagttggcttatattgttgttcaagtacacaaattccttactgatcttctgtctggttgtttcatccattattgtatctattatagtataactatctgtttcttccttcggttttatcagtgtttgcttcaccagctaggcacggtggctcacgcctgtaatcccaacactttgggaggccgaggtgggcgcatcacttgaggtcaggagctcgagaccagcttggtcaacatggtgaaaccccgtctctactaaaaatacaaaaatgagccaggtgcgatggcgggtgcttataatcccagttactcgggaggctgaggcaggagaatcgattaaacccaggaggcggaggttgcagtgagcccagattgcatcactgcactccagcctgggtgacagagcgagactccatctcaaaacaaacaaacaaacaaagacatacctttgcttcatgtattctggggatttcatgtttgttgcttgtatgtttgtaattgctgtgtattctacgtgaattgcccttttaaatatatattatccattttgtttgatattcccattttgttctttttctttcttttttgggagcggggacagggtcttgctctgttgcctagcctggagtgctgtggcactatcatagcttactgcaagccttgacctcccaggctgaagccatcctccagcctcaacttccctccaaccaccttagctggggactacaggcatgcaccaccattcctggtgattttaaataattttttttttgaaggggtagagacaacttctcacaatgttgcccaggctggtctcgaactcttggtttcaagcagtctgcttgccttggcctctcacagtgctggaattacaggcatgagccatggcacctggcctcccccatgccttttattcccttatttgggttttcctatcagtgcctcttttcctagccttatcttctattttttcttttatattttgcagctgtttttctccctgtgctgtgctctggatgatttcttcagatctgttttctagtttgctactagtatgttgatggttattttctcttagcaagtaaaaactaataatccattttttggcagtgttgttgttgagcaaatggctgtcattctgattcttgtttcttttgagataatctgtgactggtatatggattctaatttttactatttttttgaatatttaaattattcatatttaaaaattactttttggagtgtaatataatcctagatcttacagaagagaacccacttatttgccttgactgctgcctggctctcatattggtttcctagtgtggtttataattttcaactgtgaagttctgggtggcagttgtttctttgggattcccttatgtgccctgggttatagaggtgttcttatggggcattttttttttcctcttcttagagcttgcgtggtgctggttcaggattagttttaaaattaacttttagaaacctttgtgagcagtataaacttgaactctaattagcaaaagcttgtggttctggataactttattttaccacaatgggagactctctagtgtattcctacagtgtcatatgccagtagacctcatgaagggacctcattccaagctcccagctcctaagtaatgtccctttgcctgctgataaaattccaactaccacatatagtcaattcttgttattcatggtagttatgctctgtaaagtcaatgtaaacatttagttagtgaatactgaaccatttctcctagaggaaatacagggttaggtacctgtgagcctctccacgttttcagcagccatcaatacataaacttgttttacctggtttctgtttaaagaccccatattttatcatatatatagttgattcattaacattgaattcatggctaacagcactagaagctgtggctgaacgaagcttatctagcacctacttgttttctctgtaaggatgtctcagccttctttcctttaggaccaccagatagtacttcagcactatgctaaggggccatgttaaacagctaacccatcaacaagaagtagaaaaatgtgacaaatgtggcactaaatagaccaggaaaaggacaattgttttatagtatgagagctgaaacaagaaggcagtatcccccttttcaagctcagaatgtatatattggtgactcacatttttcatagctatttgcatgtccatgaatgagtgggcaaaatgtcgtaagtattgattttggtgttgcaagtacattttattgactaggcaaatttgcaaatatagaatccgtaaataatgagaactgagtatatctagttctaatctctctactgcctcagctgctgctctctgttatggctttgaatttgttcttcatttctagtacttgggagcttctttttcttgctttctcagtttgctatgtattttaaaaatacacacatgtttgttgcccttttacccagtatttttatgtatttggattaggaggaagatattttggttaaatcaatctgatttatagagtagctacttcatttactcattttaaaaaggaaaaacatatactcaagagtgttaaagagaagagaccttgaggattatcttgtttattggttcttaacatgggtttcttagggcatctggaactgtagagattgtacagaagtttatgttacatatatctttctgggaagaaagtattttttatattctcaaaggggtctataaccctttaaaaatgcaagaaccaggctgggcgcagtggctcacacttgtaatcccaacactttgggaggccaagacaggaagattgcttgagcacaggagtttgagatcggcctcctcaatatagtgtgaccctgtctctacaagaaaaaaataaaaaaataaatagccaggtgtcatggcgcacagctgtagtcccagccactcaggaggctgacgtgggaggatcacttgagcccaggaggttgaggctgcagtgagctgagatcatgccactgcactccagcctgggcatccgagctagaccctgtctcaaaaaacaaaaaaacaagtgcgagaaccactgtcctagtctagtttcacttcaaatttataggctaactgcgtatatcctcattagttcatatcagtctagttaatagcaacgttagccaaattttaaaataaaaataactacatttagaaagtgatttattttcttttcttttttcttttcttttcttttcttttttcttttcgtgagatggggtctcactctgtcacccaggctgcagtgcagtggcacagtctcagctcactgcaacctctgactcctgagctcaagtgatcctcccatcttagcctcctgagtagctagaaccacaggcacacaccaccacgcctgcctgattttttgtatttttggtagagacggggtttcaccatgttggccaggctggtctcgaactcctgagctcaagtgatctgcctgcctcagcctcccaaagtgctgggattacaggcgttagccactgccgcacccagccaatttattttttgtgaaagaacttcaccatgacatcttattttaatccccccacaagccaatgaggtatatgatattatgtttctttcacaactgtaggaactaaagggaagccacagtaactggtaagtagtagcatttttttgtttttgattaattgaggcccagggaggcaagttaacttgcccaaactcatgaaactgatttgttccagaggcaagactaaaactcctgtcttagtgatatttccactacctcattttgctttggaaaagcacataaccttaccaggtggtaatgtgatgagtcattgaaactaataaattcataagtataaagggatgcatgtgttaagagaacattttttatttcaaactgaaagtagtcaaaaccacaaagcctaggaatccctcgggcatttttattgtgtaatctgctttagaattagagttgcatccatgaagttttgagtcatattgaaacttagctacctaagtttcttcccagttaaaaactaggtgcaaatggagttatacacaatacaggtaaatatatatacctgtacttgtagataacgttttatacatgttttcctgttctatacatgttgcattgtagtttgtctcctctataagtggaaactaattaggacttgagcttcattatttccttttcttgatacaccctttttccactccctgggttgatcagtacctttggcactaatatctcagaacaattttctataggttatccttatgcagcttttatggcataatggattactggcacaattcacatggagtttcgtatatccattcgctataaattcctttttttttttttttgttgacatagggtctcgctctgtcacccaggctgaagtgcaatggcatgtgatctcacctcactgcaacctctgcctcccgggctcaagcaattctcctgcctcagcctcctgagtagctgggactacaggtgcacaccaccatgctcggctattattattattattattttttttttggtagagacagggtctcacaatgttgcctaggctgctcttgaactcctgagcttcaggcaatccgcatgcctcagcttcccaaagtgctgggattacaggcgtgagccaccacatctgacccactctataaattcctaatgtaatacagctatagtaatgaaactgtaagctgtgctaaatttttgcaacatttatttaatattcctgggaccactgaaatggtagtaaactgcttatatattaaagtggattttggggctgggtgcagtggctcatacctgtaatcccatcactttgggtggccaaagtgggaggatcacttgaagccaggacttcaagaccaacctgggaaacaaagcaagggtctgtctctacaaaaaattttagaaattagctgggtggagtggtgtgtgtttgtagtcttagctatgtgggaggctgaggtgggaggatcacttgagcccgggaggtcaaggctgcagtgagctgcaatcatgccactgcactccagcctgggtgacacaatgagaccctgtttcaaaaaaagaagatgaatttggggaaaaagtagatttaatttttcggacagcttccatctattaaattagacctttagaaattaaaaagttgatttactcttttaaagtcatacattcatttggctaacattgacgacctactttatactggacattattttagattttgagattatggataagaaaagcttttcttttctctgaagcagctcatgtattttccttctccttcattcttgctccccttctttgtatctcccaacttcccattccagttagttactgattcctccccaatctttcgataaagtttgttataatctaatgcctagaatctttttctaacatttgctccagtaacgagtagtagtcagctccagtaatgaagagctcattatctttacctggcttccccctaaaagcagagagagcttgatgcagaggcttgggagcagaggtagtttaagtggaagcaagagtgagggacaaaggaaatgatcaatgcagggagtggaaaagaagtgaaatgggaaaggaggaaaagccaatatttggatgcattattgagttggccaatgctcagacaactagtttaatcatgctgtagcctctgaagggccttatgaaatatgactgagaactatccagctggggactgaagagtggaagaatttattcagcagctccctcaccactgtatgttttaattggttctttcaaaattatttccattgttttattgatattttctctttggtgagacattgttctcagtctttccttagttcttaggcatggtgtcccgttgagcatggactattgtttcctgtgtcttagtctgtctcataattttttgttgaaaagtgaacatataaaatcatgtggcaactctggaaattagatttttcccttccccagggtggttgtttgttattgtatgcttatttattgactttttggactaattctataaagtgtgtattctttgttgttagaagccactgaagcctctggtaggtttgcttagtgggcagctaatgattgaacaatgatttaatttaaatactttgaaccaatagccttccagcttttgctgctggtcattgtgtgaattgggatatgctttcaacgacattcacctagtcagatgaccattatgccttatgtttctcttcctgcttgtgcagaacctcaaggctaagcaagaggtgagagattaggaacttcttaagtctttcatgggcctatgaatagcctggaacatgcacatattcttttttatgacccatgtctttctagattttacattgcaacttttcaaagcccccatgggcaggccattgtccattaaaaattattatgattattattttgagatggggtctctctctgttactcaggcttcagtgcagtggtatgatcactgctcgctacagtctcgacctcttgccacttcagcctcctgagtagctttgaccacaggcatacactacgtcacccggctattttttatttttattttttctagagatggggttctcactatgttactcaggctagtctcgaactcttgggctcaagccatcctccagcctcagcctcccaaagtgctgggattataggaatgagccaccaagcctggcgtgtcttgattttatttaattaattattattatttttttttaccaagtgttttggtcagcctcttgttaatttcagcttgtcacactgcttcaggtcaccataatcttaaactatttcagatgattgtttttgacaaattccccaatagcagtgttgttttcacagaatgaacttaaagtcagaacaaactaagacaaattttgagtatagagcttataggacatattaaaccggatggcaattttctgggggtagggccttgtgaaacttcaaccacattctgccttctctagtggctgctaagctgttgattttcacagctgttgtagctgtatgactgtgggttttcagtgttactgcagagatggagatggtgctttgattagcataccttaatataccaaaaaggtcactgttcttatagagattcagtctttttaaaattaaataaacagtattcagattgctaagccctttgttaatttaaagaatgctaagccctttgttaatttaaagaatattcgcaatacatttatctggcaaaagactcgtttccagaatacataaagaaatcttatagtttagtcataagacaactcaattataaaatgggcaagagatttgaacagacccttcttgaaaaaaagatacgcaaataataaatatatgacatttatatcattaatcaccagaaaaatgcaaattaaaactagtgagatactattacacacccattagaatgactaaaatgaaaataaataaataaataaccaggtgttggcaagtatgtggatcatctgaaattatcctacagaatgcaaaatggtataatcatgtttgaaaaaaaatggtcatttattttataaaagattgataaacatttttatttgatacatatttgtatgtatttatgggatacagtgtgatatttcaatatgtgtatataatgtgtaatgatcaaatcagagtaattagcatgacctaaaatatttatcatttctttgtctgggcaacattcaaaatcctgttttctaactatttgaatgtatacaataaaatattgttaactatagtcacactgcattgcaatagaaagtggaactttttcttctgtctagccataattttgtatacattaaccaactcttctttgtttctttgagacaggcctaaccaactcctctttatcccctgctcctccctacccttccaagcctctagtaaccactactctattctctacttctatgagatcaacttttttagctctcacatacgagtaagagcatgtggtatttatctttcttgtccctggcttattttagttaacataatgtcttcaaggctcatccgtgttgccatgaatgccaggattcatgctttttaattgctgaataatatttcactgtgtatatatattacattttctttctttcttttttttttttgagatgaaatttcacttttgttgttcaggctggagtgcaatggcgtgatctcggctctctgcaacctccgcctcctgggttcaagcgatcctcctgcctcagcctctcaagtagctgggattacaggcatgcaccaccacacctggctaattttgtatttttttagtagagatggagttttaccatgttggtcaggctggtctcaaactcctgaccttaagtgatccacccgtcttggcctcccaaagtgctgggattacaggcgtgagccactgtgcctggcccattttctttactcatttatatattgatgaacacttaggtcgattccatattttggcattgtgaataggtgctgcaataaaaatgatgcagatatctctttgatatactgcttttggggtcttttgtgattccagataaattgtagcatttgttttgatatttctgtgaagaatgccctttgcattttgttagggattgcactgaagtatagattgttttgggtagtgtgttcattttaacaatattaacttctaaaattattgaacatcggatgtcttttccttatttttgtgcatcctattcactttccttcttcagtgttttatagttttccatgtgtagatcttttacttccttggtcaaatttattcctaggtattttatttttttgtagctattgcaaatgtgattgctttcttttttaaaatttttatatttttaagatacagggtctcactctcacctagacaggagtgcaatagcatgatcacagctcagtgtagccttgaactcctgggctcaatcagtcctctcgcctcagcctctcaagtagctaggactacaggcttgcaccaccacacatagctaatttaaagaaaatttttttgtgtggagacagggtttcactatattgcccaggctgatctcaaactcctgacctcaagcaatcctccttccttggcctcccaaagctctgagattaaaggcatgagccactgcaacccgtcgtgattgctttttaaatttcttttttttcttttttctttttttttttgagatagagtctctttgtgttgcccaggctggagtgcagtggcaggatctcagctcactgaaatctctgcctctcgggttcaagtggttctcctgcttcagcctcccaagtagctgggactacaggtgcatgccaccatgcctggctaatttttgtatttttagtagagatggggtttcaccatgttggccagtctggtttcgaactcctgacctcaagtaatctgcccgcgttggcctcccaaagtgcttaattataggcatgagctactgcgcctggctcttgatttatttttagctaaatgtggcactcgggttatgtatacttaccaatttaccatgtaacccatgcattggagaaatgaaaacatacgccctgaagaggcttgtgcatgaattttctttgaaactttattcacaatggtgaaaaactgaaacaaacactgatgtccatgaagaaatgataaataaacacattgtggtatatttacataatggagtgttacttagcaacaaaaacaaaaattactgatacaagcgataacgtggatgaattttaaaacattgtgcagacctaaatgagtccgatacaaaggagtctattttatatgattctattttcatgaaactctcgaaaagtattgtgatgaaaaacaggtgtctacactaattaatcaatcttgttcatattctgtctcattcccttaaagttcaaagtgcctaaaaagcactatccaactacattctataatgtgtaagggaaaggtgaagtaaagacattgtggaagacacatacataaataaggtgatggagagaggactctgaaagctggactgaaaaatattgacatagtggcagaatggacggggatggggaagataaaatgatgagttcacattgtttggagtgatgtagtgaatttaaaatgatgaagaattaaatgtgtcacacacgacaagcatttctaggttatctatggattctttgtagtctagaagtcatccacttcacttgtttatctaaaatatatgagtcttttccaggacttttctcagcacaagggacaaatgtatgggaacttggaccttgtttcaagaagagctgtgaatttatgcttgttcttttttttttttttttttttttgagatggagtctcgctctggcacccaggctggagttcagtggcatgatctcggctcgctgcaacctccacctcccaggttcaagtgattctcctgtctcaaccccccaagtagctgggactacagaagcccaccaccacagctggctaatttttgtatttttagtaaagatgggatttcaccaagttggccaagctggtctcgaactcctgacctcaggtgatctgcccgcctcagtgtcccaaagtactgggattacaggcgtgagccaccacacccggctgcttgttcatatttttgaatggaatttgtgtgcattgtttcattttttgttcatttgattctaaggtgaggacagtatttcctacttttatgtagttgggagcagtaaatggaaatgtttgtggaaagctcctcataaaatttcaaggccttttgtagatatagtgttttaaaggcccagagtctggagaaaagaagagataggtacaaataatgaaaagggagactagatgcaacttcttccttattccatgcctttattttcaaaatactataaatgttgaatattatagtatttgtggtttctgaaattttgagataattttaagaagaggaataattaataactgttccttccttggctcaaataatatttaggaaatactagtaggtgtggaagagcaacacaataaatgtttttatttaatttccctgagcataacagagagcagatggggaattctgggcctgcccttttttactgttagccaaggagagcagaaaaaataaattgttttccagacatggagccagttttgtgttctcgttgctgatgtactgtgaaaggatttgaagggtgtgcatgcacttgtcacattcatgtggcttagatttgtagtggaaaatgttattctagattgtcaaaattgtgagaagccatgctaacctggtctgtgtaaaaatgtcattattattgttattattactattttcagtgattcgttcaaagagttaagacttaaaattctgataataagtatttctgaaaatgagacaaagacaaaatgctaataaaatttttggcttataatttgtttcagccaaatgcttgaacttgttttattgtgtttttgcttaacgatgtcagcttttcattaaaaggactcagtgtggttgcttgccttgtctccattttccttggtctgagagcaaatactcaggctcagtaagtccatgcatatgataggtttgaaaatgcaggatggaggaggatgatgaaactagggagagaaagaagaaatcggaaaagagagccaaaaataaccaacaagcttaagctttcctagaacatggtctaacaggttagctttgttggtaagatcagtgtgcctcaaagttaaggagtatatgaatgccctggggcttggataaaaatgtaatttctgatttgttaagtccagggtagggcttggcaatgtgcatttccttccacctcccaggcgatgatgatgctgctggccttagaaccactcttggagtgcaacaagggtcaaaagttgggttggacctcttggtgggggcatatttaaaaaatctcaataaagataacttctcaaaagtatagctaaacatgatttaattttataccaacttatacactaaaatatattctaaaattcaaaatcattgaccaaaaataaaagcatttgtttggccatgtcaccctgattgttttcattcgttgctttcttaggtcaggtctcttgataaatactctgtgaacaagttaaggagtcttcgtcttccagatagcatcctaacccaggctgtcatctggttaacatgtaaaatgtccaggtggtacctgtatcatcatggatagggctctggagaagcagacagaccacctggcttctatttccagctttgccaccaagctctgggactttgaactccacacgtataaaatggaaagcatctagtgtattgcccataataggggtttaggaaatgtgtaaggagaccctcttaagagtatatctaagtagtttcatgtcttccatgctttgagtggaacaggtcagagaggagaggtgttgaggataaaaacatgtcccgtaacttttaaggactttactgagatgccccatcctttcttcttgtgattttagttgttcaaactttcttctactgcatatctaatcttttgttttatttcattaaatgctagttgcaacctgctcagagcacttacctttggttttcttttatctgctcttatagagatgaggaaatagatcaaagcatagcattgttgaacatttctcttgttacccttcctttgcagattattcttctgctgttcagaaattttcccagacgctgcagtcatttcagtttgatttcattggagacactctgactgatgatgaaattaacatcggtaagtcttcagctacatgtggtcatatacctgttgaggcagccctgagaccatgtagtctttttgatttgtggatacagagcacttggacatcttcatccactgtggtccaatgccaaggccctgggaggttgattaggaaggatcaggaaactttccctgccagtcccatttcctcctcacacgacagcaatcaaaagatacccttaaacttctactgagatttttgactcagacagtctgcaagcgaccttttctttaaagcatagttattttcctaaaggatatattaaaagggggacttttttggtttatttcccaaaatggttggagttagattcttctaaggaatcaaatttccctagaaagtgttaaattagcatttgtgtgtctacaacttatcaggaacaggttgcttagcatctctcttgggaattggatttaacaactcactctattagttgtataatcttggagaagatatttctgtctctgagtctcatcttgtcctctgttaaaatggggttaatatctatcaaagatgttaaaaagaggaggttgaatagtagaagtcaaaagaagtttgcgtttgtattatttgttatgaaggtaaagaggagaggttaacaaacccctgggcctattccagctcaccacctgcttttgtaaataaagttttattggaacatacccatactcatttatttaagcgttttctatgggtatttttgtggcacaagaatagcactgagtagttagtgaccaccactggatggtcctcaaagcctaaaatcgttatcttctggccatttaagaaaaagtttgctgattcctgagttaaagggttagtgtagagcatttgctagatgagaacactgaaccaaagagctattatgaatgatctattgttactggaacaagttagtaacacagttatatttattagccctggaactaaaatgtgaaaatgtattattattaataaatgcctattatagtcaattttaataatatataaaagtataagttacttatgataggaagatattcctgcacagaaatagtatcttggacatacttttatattatcctttaagtctttttctctacatatatctgttttctttgtatgcaatgtagttcatattaaatatataatattatctttctaaccaaatattttattataagcattttcccatgtaatttaagatttttcacaagttttatgggtggtttgtatggccttgttttgttcactactgttttcccagcacataaaggagtgcctggcatacagtagatgttcaatgaaatgttggtaaatgaatgagtaatggatacattcaaatttcattattatgagagctatacttcatttaatatttagctattcttggaaatatagcttatttccatttttcactattataagtaatatttcaatgaacattttttagatttagattggtgaccattttggttaaatgtgactgtgtaactagtgagtcagatatttgtatttgtattattttcttattcactccattttattttacttcagtaaatctatccaggtccaagtgcatgactatttaaaagttaacattatgggctctggaatcaagtaacccaagtttgaactctacctctacatcttaatagctctgtaaccttggcaagtaacttcacctctctaagtgttaaattttcttatcttgtaaaatggggatgagataatgccaagtgtgcatagtgtctaaatgaatgttaggtatttcaacattattattaatataagatatttttgtacttctttttaaaaataactgctacttgcctatcagttggaagattgggagatacatggtacatgaaattatataaatggctcctttttctggtataagggtctgattttgaacaggtgcctattgataccaaagccaccaacagatctgagacttttctcatgtcttcctttatgttgaactttgagccttaattctcttaatcccatgaacctcactgcaaatgtcaatgagtgctatgcaggaaaaagggtgtgtgagcctgggcaaaatgacttataaacaaaagaaaaatgactccttggtgatgccaggttcctgtgggggtctgtggggctccatcagagctgctgattatgacatctttgctgcttttttaaaaaaagaaagaaagacagggtcttgctctgtttacccagactggtcttgaactcctgggctcaagctatcctcccaccaccttggtctcccaaagctctgtgattacaggcatcagctaccacacccagtcttttgcttcttttttttttttttttttttttaagatggagtcttgctctgttccccaggctggagatcagtgggctcactgcaacctctgcctcccgggttcaagtgattctcctgcctgagcctcccgagtagctgggattacaggcacccgccatgatgcctggctaatttttgtatttttaatagatacacggtttcaccacgttggccaggctggtctcgaacacctgacctcaagtgatccaacccatcttggcctcccaaagtgttgagattacaggcatgagccatagtgcccggcctttttgcttcttaatgtatgatttataataactctttaactcagtgatcatttgcctgccaatttcagaagctcctacttatcatttgaacactgcttttaaggatgctgacttaatgaactgactttcattattgaggaccaaagagaggttttgaaaattcattggcctgtcatggtcattgtccttgttgaatctcattttgaaagctgggaattgtggtggtagtgagaggaagagccagtactccaacagctgaggctgaggctctctggaggcttcgagaaaaaaatactggggaccctactgggaggctattgttgggaaagagcagttgctttggaagctgagaacgcagagtgtgccatgccctcctattgccaatactgctggccctgagtcaatacatcttgtttcactggaaaaaaaaattgcttaaagcacactttggatggaattgtgatacccttttggatttcacattatatgtgcagagggccttctcattaaaaatttttcattattggctccaaaaggtcactcagtagcattgtaggtactcgttatttagcagaaatgacagtgcttcctagagctcatggagaaagcctgaggattctgaagagttcctccccctgacgatcagctctaggacttaccctgaatagtttatgtctaacagggacaagtgggaggccatgtgtcattgatctgaccgtgacttttttcactgctttagagttagacatctatgccttcttggcattgccttgtctttacctctatgtctctgtaaccaaaggaaatcccaggtgtctaagaagtcttgtgtctgcttagatttgagttttatatgttagctatgggatcttggtaacattaattgagcttgttgagcatctgttttccacatcagtatagtgggggagtataatccacctcacaaggtcatgaggagcaaatcagataatacttatatcagagagtgtctgtaaatcatttagctcagtgtctggcatatagttggtgctcaataattcattgttattgattctactaggaacactatagaaggtaatttgtggaaaacagtgttggtttgaaattatatttcccaaattaaccaaaggaaaatataggattgtaaaatgtccatgttggcagggaccttaaatagtatttagttcattatttctcgtataacttcatatccgagtcacctgaggatctcgtttatcctgtcacaggacctaccttatacctaaagaatcagaatttctatagcggagcccagggccttgatttttacatagtctttataacatcagcgagcattttgtaaccccaggacagatctcaagcttttccaaactgtgctccttggatcctcagtgtctcccgtctttcatgatcaaatgaaacagcggtttatattgggctttcatgtaagaatttgcttgaaaaatgggatttgtagattaaacgagagaaacagacacttttagagtgctcccaaatagcagatgtcattgtaagcactttatatagactaatgagagaaagagagacagaatagtagcaagtttatccctcaattcaacagatggagaaactgagatccagaggtagggatgtgattgtggaaggtaccacacagctacatagtaccagatttactattagagcctgaatctcctaaggcccaattgattcattcaataacattttattgagcatctgctataaagcttgtcctcatggacttcccaatcatacaagttttggcataggcaaatgacttgcaatgtcaccatagcaccatgagctagaaagaggcctgtttgccacataggcttaagagaatatgcttactttttttttttttttttttttttttttttgtgatagagtctcactcttgtcacccaggctggagtgcagtggcgtgatctcgactcactgcaacctccgcctcccgggttcaagagattctcctgcctcggcctcccgagtagctgggattacaggcatgcgtaaatacatgcccggctattttttgtagttttagtagagactgggtttcaccatgttggcccggctggtcttgaactcctgacctcaggtaatccgcctaccctggcctcccaaagtgctgggattacaggcgtgaaccactgcacccggccaggttactcttttctcaggatcccttatatgtatttttgttcattagtaaataggtagcgtgtccactaaatgacataaacaagggattcagagacatagaacacatcttcctgccttcaaggagctcatagtctattaaaggaggtggataactaaataggcaatggtaacacaatgtgataaggactatggtagaggtaagcacatggtagcccctaattcagactggtgtgtatatgtattgggggacgggatgatgcggagaataaacatggaagccttctcagagaagtgatatctgagtcagttccagggttaaggtgaaacaaggcaggtggctagggctcagatttaaggaggcacttactctcagggttgtgcaagtacaggctggcacttgagagtgaatatacctccttaaagtttacagcctgggtacctgggaattatttggtgaggatcttcagagggcctcgtattttaacttcaaatttcaatcttgtcatcagcagagcatggcatccattaggtgaaccctgatagcatagttcttttattctgtgcatctaccttgctacatcttttccagaaaatgtcacccatggggttttagtgggttgtttgtttatgcctgggggaataaaagtcatgttctaaatctcagactgtaaatcacatttccaccccagttatgctaacatatttaaagaaacacctttgtggaccaagaagattgatttaaggtcagacttctagatggaaagttccatcagccacccattactggtttctgagacatgagggtttaacattgtcagtcccctgatcctgatttttgtttaatgtgaatattattcattgctaaacaactcacagcagatcataaacctcttggttgagataaagaagggactaagaaatagtctcttgagggcttttgttggtatttttttctacaaaaccagttgaagtatcttttgagaagtggtggcaaatgtcagttgttttagagtcctggaggtcaggcatcttaaaagaggaatggctaaaatgaaaaaagaagcactaatgtaaaagattgtatttaagtaaagagccaggagttgaattctgaaggttcagtgattttcatgagattggtggggggaaaatcttttggttatacatcttgaagctcttaagctcatatgtcagttggtgacattgttcacaatattgattatctttcatataggggcatgcatgaaccaaatattttgccagactttcttagcacaggcaatagcttttctggggaaagttctagcccaatgcaccttctgctgtggtgataagcccttagaggtttatatcaagttattgggcttgagtgcatagggcttcttctcagatcctgaggaaaagagaaaatacaaggtaatcagaagtctctattgggatctgggccgtcaggttttagttctccatgactcgaagtcatatgagaaggtgataattgggctgggtacggtgcctcatgcctgtaatctcagcactttggaaggcaaatgtgagtgactcacttgagcctaggagctgattctaaatgctttcagggaagcatcagattaaaacataaaaacctatgtgtagatgagaaaggacttaaaatggcagtggccaacttattactgatcattttcaaaagtggaagacttgatgaaattttattaccagaagaataatgcaactgaaaaatacatgggatttatgtggcatataaaacaaaagaaatatcaatccataaaaagattttacaaaaaatctataatcataataacactattttcaaggaagagtgaatattatatttataaaaattggtaaacaacctttatgaagaaaaaagtcttcagacataacataataattctgacataatataccatgaacatagcaagcttatagttagaatataccaagaatatatcaataatatcaagtaaagctgggctcagcgatgcatacctgtaatcccaggtactcaggaggctgaggtgggaggattgattgaacaacccccagccacccaaaagaatatcaagtaaagagattgagaaatcttaataaaacatactgtggaaagcaagaacattgatcgttctctaagaacttcctgtatagcattcaatttctgaaatatgtacattggtaacgtttagcccatttaagctagggaagtctgaacatctcttttgatttcatggtgcttcctgtgcaactcagacgataaaacaaaaagcaccaaaactatgcactggacaattaaggaagttattgccatagggagaacctttattaatgaggaacatctcaaagaaatggaagaaaattggggtattgtagaggcaggtaaacaagggagtcacctgcaagtcttatgggaggcatgaagaagaatggagattgatgctatatatgaggtgcaaagtctatatatagactttgcagtctaaccatttttcagaacacagaaggatgtgggatgtcttaacactggctgctttcttggagccctggtctcagttccacactcagtggtccgggattcacaaagcagggcacaacccagtgtcctttcaaagctcccaggccctctgaggttccactggggaatttgagtgaagaagatggcactcatgcagagtgaggagactgctgaacatgagccccctattctcataggctttttgtacctttttgcccatttcccttctgactgatctggagactgactgctggttaagtgccagccagggtcaagtaagtggtacaaaatgatcccaagacgttcctatttgttgagagatctagcaaagtgaatgtcattttctcaggagcatcatttggcaggcccaggcttcaggcctgtctgccatttactctttctccctcattaaggtctcttggactccagtaatctttcactctgagctctcttctctatcctgttcctgccaccatattgtatccatagcaatgacccttatatcttggctcacttttcttcatggggatatggtaggatttagaaacatggtcttggatttggctggacctgagttcagactctgacctgtttatttactgactacatgatcttaggcagttttcattaaaaaaagtaataattgagtttattggtatctttgcattataatataaacatgctttattataaaaatatggaaatgaacaaaaagattattattagcttccgtatactgagtacctactgtgtgcctactgctttgtgtacactatctaattctcagagcaattttaaggaggtgaatgaggctaatggaggttaagaaacttgcccaggatcacatagctaataagtagcttaagtgggattttttttttttttaatcagggtttggctctgtcacctaggctggagtgcagtggcaggactgtggctcactgcagccttgacctcccaggctcatttgattttcccatctcagcctcctgagcagccagaaagcacacctcacctggctaatttttgtcgcttttttttccctttctttcttttttttttgagatggagtcttgctctgtcacccaggctggagtgcagaggcacgatctcagttcactgcaacctctacctcccaggttcaagcaattctcctgcctcagcctcctgggtaggtgggattacaggtgctcaccaccacccctggctaatttttgtatttttggtagagatggggtttcaccatgttggccaggcttgtctcaaactcctgatctcaagtgatccacctgcctcggcctcccaaagtgttgggattgcaggtgtgagccacagcacctggccctaatttttgtagcttttttcgtagagttgaatttcatcatgttgcccagactggtcgtgaactcctgagctcaagcgatctgcctacctcggctttccaaagtgaagggattataggcatgagccaccatgcccagctttaagtaggtctttaaatcatttcatttttgactttaaaatttatacatatatgcactccataaccgtgttaatgtcatagtaaataatcaataaatagttaagcctgagagctagatttaattaaaaaaaaaagaatcaattattttgatgtatttttttcttggcttttttgggggtcgaaacaattttctgcatatagctgtacttgtgtacaattgttgcatacagatttttatattctgtttttaaatagtgtgacactctagctattttgtcatgtacagaaaattttgtgtaatttcctttttaatagcttcaataatagtccattaagtggacatacttaataatttcccaatcattggacattttatgtgttttcaattattcatcatcagcaataatgttgaatgcctacctttggatataaaggtttatccctctgtattcagaattagttctttttgtttgtttgtttgttttttgtagagatggggggtctcacttttgtagagatggctcactgttgccatcaggcatttgagcaatcctcctgccttggcctcccaaagtgttgagattacaggtattttccaccatgaccatgccatgattaggttttaggtatggtttcccagatacgaatttacaatgtaaaagggtatagataattttaagctgtttgatccacatttgtcaatttttacaattgtttggaagacagtgcataacactgtaatttatatgaccttgctaaattaaacctcagttttctcatcactgaaattgtaatgatgaataataaaacacttgagaaacatctaccatattgcttttcccatctcacttttccgaattttttgtaatttctttgaaattttccaaggataatgttctcttgctgtggtctttttttaaaaagaaaattcttggattggtaaacattattgaggaattttgcagtaagttttataagccctgctttgtggtggtgttgcggcaggggatgttgctattattgatgatggtgttgttgtttgttatggttatgcagggctgttttcttccatttcttagccaattttcttagtcctcagtcctagtatctgaagagagggcaaaaggactctaatgactttggctccttaatgactattctctcccacactctgtaatggacagtctgatctcctcactaaagcttttattgccttcccattaattctacagagccgtctgcagggttagtttttagaagatgctgtaattaattatccatgatatttggttaaaaatagatccgtaagaggctttataggacctcaagattctgagtcagaaataacccttgtccaaaccttccgcttttgcctttttcttttgtcttttttttctttttctttttctttttgagatgaagtttcactcttgtcccccaggctggagtgcagtggcacgatcttggctcactgcaacctctgcctcctgggttcaagcaattctcctgcctcagccttccgagtagctgggattacaggtgtctgcttccacgctcggctaatttttgtatttttagtagagacgggggtctcacgatgttggccaggctggtcttgaacgtctgacctcaggtgatccatcctccttggcctcccaaagtgctgggattacaggtgtgagccactgtgcctggttctgcttttgcccttttcttgatttgctatagatatgaccaagggagagtgaatatgaggatatttggagaagaaaacaccatttgtggggccagttggagggacagtgaaaacaatgtgacatagtgctttcactatgactggggactgtagatagaacattgaaatggggtcctcttttgactgttcagctagctgtgtgaccttgaacaagtcagttccaatctctgggcctcagttttctcaggaataaaatgacatagttggactaagatagatgatctgtaaaagtcttaacctttttagaaagcaagtgattacaatcttagaatcaagaggctatcttgactttgctacatgcttcttgccctgtgccacatacttctctaggcatttgcagtcttccgatcaagcaataaatgtactcatagggctttttcaggccacatattcagcaatgaggtttttcttgactcagcaacttaattttaaagtgatttaacaattactgaagctgtatgttaattgaaagtaaggatcaagaagctctgaccaggttaccacggtgggaatagttgaaaaatgacctccaaaaattcgatctttcataaaagcagcaaaaacactggcagaaatttccaaaatcaacttttttaaaactccaaaaacgaaccaaaattttgcaacaaaacagtgcatgtttattaaataaaaatggctgaatagttgagaaaacactgagctctatgacattttaatttgccatgttcctattcctttctgcagttccatagtagctttgaaaactaacgtctgtataatcatgcaatgtgtgcaaaccaccattctagcagccatgggtgagggtagaatgggtgtgaagttactcaaaatttgagaaatatcactcacagggcttatgttatttgagttgactcagagtttactctttaaatggttgttgttgttgttttactagcgcattttctttcttttgtgcattttttttttttttttgagacagaactcctgacctcaagcaatcctcctgccttggcctcacaagcaatcctcctgccttggcctctgagattaaaggcatgagtcactgcaacccacttgtgattgttttttttttttttttaatttcttttcttttccttccttccttcttcctttctttcttcttttccccttcccttcccttctcttctcttttcttttctcccttcccttcccttccctccttccttctttcctttcttcccttccccttctcctccctccctcccttttctttctttctttctttctttctttctttccttctttcttccttccttccttcctttctctctctctttcttttttttcttcctttctttttctttctccttccttccttccttcctttcttcctttcttaatttcttttccttccttcctgccttccttccttctttctctctctctctttctctctctctcatccaggctgtagtgcagtagtggcatcttggcttactgaagcctctgcctcccgatttcaagcaatattcctgcctcagcctcctgagtagctggaattacaggcacctgccaccatgcccagctaatttttgtatttttagtagagacaagtttctccacgttggccaggctggtctcaaacttctggtctcaagcagtccacctgcctgagcctcccagagtactaggattacaggtgtgagccaccacacctgcccctagggcattttctaaaaccattcagtggcagttgtttagtactacagtttccacagacaacaaaaagaataaagtagcaaataagaagctgaacaataaaccaaacaggacaaaatggagaatgaattatccttggagagctttgaagagctgtgagatattcctggaaatctaggagtcatgcacatgagaggggctttgtacatacccagcgtttgtatctgtctagaagatacaaacaaggagattagacttgagacatctaatctcccacttctggctgaccttcagctctttgcaaggaggagtgaaggctaaggcacagttgtaaactgtctggctgaatgttgaaggcacaccccacaatacacagagagcccttcagcaaaggcttggagatatttgttcaaaccatttaaagaaatctctgtccaatcacttgttgaccagtaagcttactgaccagagactttagtggtttcatatgacaaagaatgcagactatagaatgagtccatgaagccaatgtaacaacaagcaaccacaagaacaacaagctctggggaaagagaggagttctgatttccaaagttgccacactatttagaatgttaacttttaaaaaattatgagacatgcaaagaaatagtaaaatatgacccttgaacaagggaaaaaaagcaattaatagaacctgcccccgaggaagcccttacattagattttctagacaaagagtttcaattacctatttaaatatatttaaattaataaatgagaccatgtctaaagaacttaagaaatgaatgagaacagtgtctcacaaaatagacaatatcaataaagagatagattttttttaaaggaatcaactgaaacttgcagttggaagttgcagtataataactgaaatgaaaaacttactactgggggttcagcaccatattgtactgggaaaataaatgaccagcaaatttaaagacaagtgaattgagatcattcaatctgagggaaataaagaataatgattgagaaaaatgaacagaacctcagatacctgtgggatatcatcaagcataagagcatatacagaatgagaacctcagaagaagagagtgagacaggaaagaaagaatatttgaagaaataatggccaagaaattggcaaatttggtgaaaaacatgaatctgcacatccaagaagttaaatttagagatacatgcctaaccatatgagtctaatgaaagaaaataacagagataatcttgtaaaaaataagagaaaaatgaaagaagagaaatgaatgaaaacagtcacaacatactaaatcttatgggatgctgctaaaacagtgtttggaaggaaatttgtagcttcaaattcctatgttaaaaaagaacaaagatatcaaatcaataaccaaactttccaacttaagacacttgaaaaacaagagcaaactaaagaaacaaaagtaaagaaataataaagactaaagaggaaataaatgaaatggagaacagaaaaagaatataataataaggcagccttgtcaaaataacaagacagtcattgaaaccaaacatctgttcttcataaagttaaacaaaattgacaaacccttagctagactgaccgtgagactacttgaattactaaaatcaggaatgaaataggggacattactactaatcctagagaaataaaactgattataatgaaatactaaatatagttgaccctcaaacaatatgggttcaaaacgcagaggtccagttacaggcagactttttctctttgatttggatagaaaaatacagtatttgtgggatgtgaaattcacacacatggagggccaacttttcatatgtacgtacattcacataaaacttgttcacaaatgttcatggttgcataaaccagattcagaggtcacatgtgtttccatttatgagaaatgtctagagtaggcaagttcatggaaatagaaaatagattagtggttatctgggtgttgggaggaagtggtaatggggtgtaatgctaatggggtttgggtttcttttgggggtgatgaaaatgttctgcaactgtacagtggtgatagttgcacaactttgtgaatatactaaaagcccgaattgtacactttaaaatggtgcattttattatgtctcagtccatttgtgtcaccataaaggaatacccaatgctaggtgatttatgaagaagagaggtttatttggctcatggttctgcaggctgtataggaagcatggcatcagcatctgcttctggtgagcacctcaggaagcttccagtggtggcagaagaagaaagggagtcagtgtgtcacacctcacctccaacattggggatcaaatttcaacatgagattttgaggagatagatacccaaactatattatatggtgatatcaattcagtgataataataagcacctaataaagatattgtcacaattaaaccctcaagcagaaggcttggcacatttaatgtccatgaaatttagtcttttcctttaaatgtttgaatatgatatttgtcacatttcctttagaggtaaactgatcgtgtctggaaaaatgccaattaaaatctctgactcttttcttagcataaagtatttggggacagaaggtcaataaacatttccattttttcctgtttactctttctgagtatggtgtttatcttttctatgctacggttgagctctgaatgaatttagtgttttcaaaggtgatctccctgggtatttgcagcaacttaatcctcagaagaagaaagaaatgtcattgccttgcatcctgtgttgactccaaaattcatttccttgacaccaggaatgctggacttgttcagttgttttaaggaggaaactcaatttttgattaaaaatattagtatagacaaatttgtttttccaggctttcattcagatgccagtcgagaatatacttcctgcttctggagagaagttgaggaatttgaataggcactaaagactatttagcttaacttacttttttttgtatataaagacattgaatttctgagaaaggaagtgatttgcccagtcatcctgccagtaagtggcacaattggcactagaagagtagaaagtttgggagggtggaaagggtaatgtttattatttactttgtgttgacactacattcaccatccaatttagtttttacagcaatagtctctggttggtcagtagtggaacagggatccaaactcgtttcagggttctatagctgccaattaattacacagcaaacctcttgccccttccctaatcttttagcttgtctatgaaataagagaaattctagctactcctgagtggctgtaaggattaaataaaatattaaagtgtatggggattgataaaagaggaaagaaaagaaaagaaacattcaacaggtgctgaacacctgcttttgtcctccgatttgacaccttcctctagtggccatgtgggcatagggcactggtccctacttcctgttgcacagatctctatccatttgtctgtcaagcaccatgattaatttgttttacatttgattctctccttccagctgaatccttcaaggaatttgctgaattgctcaacgaggtagaaaatgagaggatgatgatggtaagtcactaacgctgtcactgaagctgagttcatgggtgatataggggatttttcctttcctttatgcttggattgatcctatactattttgatttctgtcagatagcttcttggtgctataaaaatagttaggtaatagatctggttattatgtctcaagcttccaccctgagagtttggcattagatagagggaaattaacgtgcaaatcccatctgtgttcatttcagtgaaaaataatttcagtggatattaaactgggcctttgaacatgttgacagaaattgaggtctttagtgtttttagccaaattatccatttgttaatctttaatttgtggagtagttttacttttatagagaaaatcagtagaaaataaagatagaactcatataccacctttctctctcccattcagttttccctattattaaacatcatgtgaatgtgatacatttgttataattgatgagccaatattgaaacaatattattaactaaagttcatagtttacattagaatttactcttggtattatacattttatagatttgacaaatatataatgacatgtatccaccattacagtgtcaccatacagaatagattcatggccgtgaacatttcttttgtccaatctattcatccttctcttccttctccagtcctgaaaccctgacaaccactgatctttctttttattgtgttttgccttttccagaatgtttatagtagatatcaaacagtatgtagccatttcagattggcgtatttgacttagcaatatgcattttattttcctgtcatttatttttatcattaagtaatatcccattgtatgatttaccacagtttgtccactcacctactgagggacatcttggttattttggcaattataaggaaaactattataaacagttgtatgtaggtttttgtgttgatacaaatttccaactgatttggttaaataataaggagtgtaattgctggagtgtaaattgtcagggtatgtttaattttgtaagaaattgccaaccaacttccaaaatagctgtgccatttcgcataaccagcaatgaatcagagatcctgttgctccatgtcctcgccagctccatgttcttaccagcatttgctgttgtcagtgttctggattttagccattctcacggatgtgtagtggtatctcattactgttgtaatttgcaactccctaatcacatatcatgcagagcatctttccatatgcttaactgccatcggtatatcctttctggtgaggtatttgttcagttcttttgcctattattaaattgattttcttttgttaagttttaagagttctttgtatattttagattccagacctttatccaataggcatttgcaaagattttctcctcgtctgtggcttgtctttttattttcttaatagtctcttttgcattgcataggtttttaattttaatgaagtccaacttacacatttttgctttaatggatcatacttttggtgttatatctaaaaagtcttttccaaatccaaggtcacccagattttctcctatgttatatttttggaattttttagctttttgttttacatttaggtcaatgattcattttgaattaatttttatgaaggatataaggtctgtgtctagattcactgttttgcatgtggatatccagttgctccaacactgttttttgaaaatactattctttctccttgaattaccttttgtcctttatcaaagatcacttgactatatttatatgggtctgtatctgggctctctatttctgttgcattgatctatttatctattctttcacaaataccacactatcttcattactttagcatggtagtaattgcactgtagtaaaaagcattgaagtcaggtataagcttaagaatcagtttgttcatatccacaaaataacttgctgggattttgactgggattgcttttaagatcctagagatatctttttgattttgattaggatttgcttttaagctaccagggaaaaactgatatcttaaaaatattgacttttcctaattataaacgtgggttatctctccatttatttatatcttttttgatttttttcatcagagttttgtagtttccttatatagatattttatgtattttgctagatttctacttaagtgtttcatttttatgaagtctaattattttaacagcctaaaaataatctttttgtgtggtccttagaccggcagtaccatcatgaccagcaccagcagaaaattattggaaatactggtccttgtacccatcccagacttattggggacttaaatgttgaaatgtatgcgttgatcaatattcatttttattaggggcatgatggtaagatgggaattctgttttacttttctccatcagatgactttttgtgggcttctcagttttgttaaagctatttattccaacagccagaactaatttacctataaaatccctttcttttcaacagtgtggtactgacttctcaaaatactgctcatagaatctagactcctagagaagtaggaatgaaggcaggacttggaggtaggggaattagagaattaaggctctaattctggatctgtcactaacttgttgacttcagattaattacttcatttttctgggctcctttttcttatttgtagagtgaggaaaataatccccatctcttatggttgtttaaagtgctccaaataacatagtaaacatggacgtgttttataaggggaaaatactgattatgtaagcatggtttttagttatctttagttactcacaggattctgcttgtggaaatatgatttgggaattttcttagtttaaaatatttgcttttaaatgtactaagaagagaccaatatgtgtggtttccctggaccctcttagatggcccccttgctaatacacagtctactaaatgttcttctctgcccacagggtttgtggactgctgcctatgttgttttcaaaggcatttgcccccatttcattcagatagcactagaaagctcagctgtacttctctttagccctagttgtttctccatctcttttatttacccaataacaaagccctcacatattgaagtagtattcatcttttgagatgttgtttttctcacccttcctgctgatactttgccacatgactgactcattttcttctgtctttaattatgttgtgcccttttgtcccaacaacttttcaatcgtatattgagtgtttgctccctatttcccacttaattccaggaatgctgagatggttaggcttaatgagtgcctttcaccccatgccaggaattcattgcttgattataacttttccatttcctggctttgtagcaaaaggacccctctaccccagtctggataatttagtgggtcttatattgcattttatcctttgtaaaagaagagtccaaagtaagctttagaataacagtaagaaagttcacagcactcaagcatggaaattgcctgtgtctggtcatctccataaatgaatataaattggggaaggaattatgatggggagaagtgaggaagggcatccctgtgatgttctcaaaagtatactgttggggctgggtgcggtggctcacgcttttaatcctagctctttgggaggctgaggcaggcagatcgcttgaggccaggagttcaagagcagcctggtcaacatggtgaaatcccgtctctactaaaaatacaaaaattagctgggcgttatcgtgcatctctagtcccagctactcgggaggctgaggtgggaggatcacctgaacctgaggaggtcaaggctgcagtgagccatgatcatgccactgtactacagcctgggcgagtaaggccctgccaaaaaaaaaaaaaaaaaaaaaaaaaaaaaaaaaagagcgggggagggccttgaaaagtctgaattgcacacttcttatatgattatgaagcttgcctagattcctttctgactctgaaggggcctctgttggcaatgtgcaaggtctgtttttgaagacggccaaaagtgacctaaagaggcccccataatatttcagcctgtctttagtgctctttttttaaaaaaaaattttttttattttattttttgtgacggagtctccctctgttgcccaggctggagtgcagtggcgtgatttcggctcactgcagcctccgcctcctgggttcaagtgattctcctgcctcagcctcctgagtagctgggactacaggcacccaccaccatgcccagctaatttttgtatttttagtagagatggggttttgccatgttggccaggctagcctggaactcctggcctcagctgatccacccgccttggcctcccaaagtgctgggattacaggcgcaagccactgcgcctggcccagtgctctcttttgatatttcatttaccatcaaagattcctgagcagtcctgcaatactggactgaatatcatctctattctgctcaacaccttcagtgttactttggcctttattcaataggattctgatgatagaaactcactaatgagtttaggatgtcactcgttatggtgaagagtctacctgaggtagcaggtgggagtttttgtccccagtgagctcacacaatgaatgcagtgattagaaaagagattaaaggccaaatttacttcaaaggggagtcattgctagagttctaaggggtttaagaataaaatggagtgaaaaagaaaaaagaggaaatcctcaatgtgacttttttctacattcctaagtctctattctgaccagaaaatagtataataaccaatgagtgtcatagagaggaaaagattcagagtatctgtttgtgctgtaggagactgggagcagtgttgccaaagtgattaagggaaaatgatgtcctgcaattctagtaaagcatggactatttttcagactgaactggggtcaaacatgtaaaagtcagtggccttatggaccctgtgagagaagttgctgacacacttgcttatgcaggacaatcccctttggagcatgaaaagccagcaactctgccctcctgggggttcctgaatatgcaagggcccagctccatacagtgctttagaaagtagtatgtacacttcttattcaaaggaaaacttcctcaatgtttcacagttggccacttcttaggtattacatttatttatttatttatttgtttttgagactgagtcttactctgtcacccaggctggagagcagtggcacagtcttggctcactgcaacctccgcctcctgggttcaagtgattctcctgcctcagcctcccgagtagctgggattacaggcatgtgccacctcgcccggctagttttttgtatttgtagcagagacggggtttcaccattttgaccaggctggtctcgaacccctgaccttaggtgattcacctgcctcggcttcccaaagtgctaggattacaggtgtgagccactgcacctggcctgtattacatttttttaaactgcaaattgtctttctaattatctattgcttcataacaactttttctaatattagtggctgaaaccagggtccccaacccctagcctgcagggcaccagtctgtggcctgttaggagcctgaccacacagcaggaggtgagcagcaggatagggagcattactgcttgagctctgcctgctatcagatcagtggcagcattagattctcataggagcaaaccctgttgtgaactgggcatgcaggatctaggttgcatgctgtttatgacaatctaatgcctgatgatctgaggttgaatagtttcatcctgaaaccatctccacctccccctaccctgggtccattgaaaaattgtcttccatgattctgctccctggtgccaaaaaggttgcagattactggcttaaactaaaactaattatttgtaattattttttgggttaggcattcagacgggtcagctgggcgattcttctgctccaaatgatggcatttacctggcagatgagttgatatggagggtccaaaatggttttcctaatgtttggcaccttccagtggggatggcaggaagggcggattcagctggtatgagacattgactagaatttggcctcttctgtttggtaatctcagggtaattaaacttcttatgtactgtctcaaggctcctagtgggagtattccaagagaactgggagagaactggtgctggccttttatgacctagcttcaaatgtcacagagtgttacttctggagtactctatttgttcaaaatattaacaagcccactcacattcaaggtagaggggacatagacctcacctctcaatggaaggtatgtcagagtttgtggccatgttttaaagcttccacaatagtaaaggagaaaaatgactttctgtactggacctatgacaccaataacttaatttgtgggtatttttagtagaagaagtcttattttcaattaaggagagtcactggtgtaatttttttttgataccataattgttagtggagctttgatttcctaagcaaccaaaatgaatctttctatgaatcagacctgcatagagaagtctttactaggggctcttgcagggtggaatttatagactttcctgcctttggcaaatgagcacactcagagataaagagaatgttaagtgtcgtactgggaggtaggttatagtacgattaggactcaatggggtttcatagatccagtagaagagaagagatgtgatgagaatcagacagggtctggaaatgttagcaggcaagaggtctgattttgtaaaaatcagcaaactttgggaagggtttcatgattttttaagtctaggcttgtagcaaacaagttttagaaagccaactataaaagcactggtgatcaggagacatagagaatgactctgttctcaaggaaaacattttttttcttgcctagttttatatttttttttgctgggtgctggctgtcctggatgatagcattaggagctgcagtagatcagaatgtcagggttcaccaagatgttctcatacaaaggctggcagtgccattttaggagttttcccatttagttgaaccttgaatcatacctatacacagaacaagaggcccaaattacctgaaagacacgtataacctatgcactaatgccccacaactttccacacttttggggaggtaggttaaaaattgcttcttagattggagaactcagatcttgtcaaaactggctttttcctctgttgtctatttttgttatgaagatatatcttgtcttactgacacctatgtctcatatgacaaggaaacttgtcttttagttttctgtcttgtaattaataaaaattaatgcaatgattcccaaaatgcagccctttagatgccttctctagggtcttccattttagtgattctaactctcaccatggaggcacaaaccccacttgttgccttgaacatatacaatctcataagaggtttatatgaagaaaaagctttgtatacctttacctgcccaaagaacaaggggtcttctttgattttgatgttttcatatctccagaacatatttattattgccaatattaatagtccctgaacaggccattcctattagcttctgagcatttatatttaggtaatttgaaagcctagtctagtgttttctgcgatgctgtaatgcactccatattctgaaggaaatgttctggttttatggcacaggcaggactgtaaatgttttatcctaatgctatcactgcacactcatttgcctctgatgaaatgatttgcacttgctgcaattgtccttttcttgtatttgccattctctttctcttctctttttcacctgtccttcaggtctcctgtgtcctctgctggacatcacttcagatatttatcgattaaaaactcaggtcagactatcattaaagttacagagaaatgcccctcttattctttctcccatttcttctcaatgcatttgatttttcagaaacaatatagaaacaaacagtaacaaaacccaacaaatcagcaaaccatttaacattttgcaggttggtatataaatgaaaatgtagtaacaaggaatcttgtatctgaaccttgttaacctagaaattgttttgtttgtttttcctttttgtctaggtacacaatgctagtgatttgctgattaaacccttggaaaatttccggaaggaacaaataggcttcaccaaggtacattttctgtatatgcataagattttttaaaatagcaatcgaatagttgtatgggctactattcttcactttacaaagatatgcaccaatctgctggtgctttgctcttggcctagtcagcctcctaaactgtgcaaaataaatgtttgttgtttatgtcaccctgtctatggcattctgttatagtagcctcagctaacatgacaaagggggtggggaggtgggtgattagtttctatgagaaaatgatcacgaaagagagtaagaaaatctagaattggcctctgactttgtggccaacaggctctgtatctgtgcataagtttcttcttcttttggtgtttttgttgttttgtctggaaaactagctagctatcatgtatcaactgcctgctatattgagcactaggctaggtgctttacgttcattctttaatcacaaggactttgtgtgcttctggcattttccccatttcacaaatgaggtaactgagccttggacaagataaataacatgaccaaagttatatagctggtgatatagtttggatctgtgtccccacctaaatttcatgttcagttgtaattcccagtgttggaggtggggcccagtgggaggtgattgcatcatgggggtggatccttcatgaatggttcagtactatcccctcgatgctgttctcctagtggtgagtgagttctcatcacatctggttgtttgaaagtatgtagcaactcccccacttcttgctcctgctctggccatgtaagatgtacctgctttcctttcaccttctgccatgattttgtttcctgagacttcaccaaaggagaagctgctgtacttcctgtacagcttgcagaactgtgagcccattaaatctcttttctttataaattacccagtctcaggtatttctttatagcagtgctagaacagactgatgtggttagtaagtgatagtggcctggatttagacctaaaggtctttttagctttacgttccatactctttacattaagctatgctgtctagatctttgctgtctattatggtaactactatctatttaaataaaattaaattaacaactcagctcctcattctttctagccacatttcaagtgctcagcagtcacttgtgtctagtagctactgtgttggacagtgcagataaaatacatttccatcattgtgcaaagttccgttggacaatactgagtgccagttaatttcattcttttcagcttgaccatcacatggatctctgtgattctccaatgtctgttgaagggatgttaataattttcatttttaatcttttcagctaggtgtaggtctgtttcatgagctctcaatgtgtatccaccatgtagcaaaggtagtttcttctaccagggctaaaatacagcatcttgtccaagcatctagttttcttaggactaagagcataccaaccagtagatattatttggaatatgatgacaatcagtttggatcaagaatttgaaaacagcaagtttttctttttttaaaagacactttcttgccaactcagcctcccaaagtgctggtattacaggcatgagccaccatgcctggccatgaaagtaccaaattttgagaagaaagagcaaattagtggttgagctcccactacctgctatcatcagattgacatgggcattgttagaaatgactggtgttcaagcaaagtgagttcccctcatagcccagcaatacttgtttcactggagtctcattaacatcaatacttagttgggagaggatatgattgaagaatagaagtatatttaaaattacaactgaggataaaaatacttaaccacttgtgaaacaatttgatttactttcattcccttataagaataacactaggaaagtaaggatatgctaccatggttgccctcatattatctgagcaaatggaaatgaatttgtattatgtgcagtcatgcgtcgcctaatgttgttctgagaaatgcatcattacatgttttcatggttgtgtgaacttcataggagtttgcttaacacaaacctcgatggtctagcctaatacacaactaggctatatggtatagcctattgctcctaggctacaaacttgtacgggtgttaactgtactgaataatataggcagttataacccaatggtaagtatttgtttatctaaacatataaagcatacatataaaaatactgtattataatcttataggactgtcattgtatatgcggttcattgtttactaaaacattgttttgtggtgcatgactgcacttcctatggcccatgcctgcactgagggttttacatatgctttcttccttaattctcacagcaaacctgtgaggtaggatttttaatatccattgtctcaatgaagaaagtgagtctcagaaaggttaaatatgtatctatcttttttcatacttctttaccagtaaggccaacctgcatatctacaaagaagaccaacttagtatgagtcatgtctccaataaactatctagaattccaatagtcaaaatgaagcttataggctacccctgtgtgttatcaatttattgccaatcaattccaagcctctcaatacctgctctgtgataatggacagattttctttaagcatctttcctttatagtgagcacactcttaaactttctcagtagagggagctggaggacgttgcaggaggaagggggatctcttgaagtttccagctgaggcggggttggggcagggtggggaggacagcttgatggaactctgacccagccacccacccagacacatggtgcctcaatctccttgaagccttcatgaccatgctgtccctcagcttccttctgtagaccccctaccccacatggcccacttgctggctgaagagttatcatgcagctattaccctctctgcagggccctcatacattgagcttgcaccctagggggttctcaccaaacaaggctggccccgttgagctcacctgcaactcagttttcccaccttctctttataccttctccgctggtcactgttggcctgcttttttgtaatctggtgagttgcctcctgcttacatagtaactatgaaccaccgggccaaatcagcaaacattctgctatccggagtgttaaattactccttttctttttttgtgagacagggtgggtctcactctgtcacccatactgaggtgcagtggcagaatcatggctcacttcagcctcaacctccctgggctcaggtgatcctctcacctcagcctctcaagttgctgggactacaggcacataccaccatgcctggctaattttttttttttttttgtaatttctgtagagatagggtttcgccatgttgcccagactggtctcgaatgcctgagctcaagcagccctcctggcttggcctcccaaagtgttagaattacaggcgtgagctaccacgccccaccaaattactgcttttcaagtgaggtctgaaccccattaaaatttctccttatttgagtacttttccttaaacttagagtaccatatagagttttcttatatgtcaattatttgtaaggttttctatctcctgattggacttagcctggtatacccagcactgctgctagctggctttgtgagttcactggttgtgataggtgctatattaggcccttactcatacatatccagttctcatttgaacctcagaacaatcttgcaaaagttattatcccccattaacaggtggggacactaagttcagtgaggtgtagcctctaaggtcactcagtagcttggatatgaattgagatctggttgtaagtctagggctcatttcactttgcaggaaacagcacttctctccgaaccttagttttctcatggctcatgacaacaagaacaatggacaaatattccaaatctgatcttctgttagtttgagattctttttttttaattattattataatttaagttctagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccagtgtgtgatgttccccttcctgtgtccatgtgttctcattgttcaattcccacctatgagtgagaacatgtggtgtttggttttttgtccttgtgataatttgctgagaataatggtttccagcttcatccatgtccccacaaaggacatgaactcatccttttttatggctacatagtattccatggtgtatatgtgccacattttcttagtccagtctatcattgatggacatttgggttggttccaagtctttgctattgtgaatagtgccgcaataaacatatgtgtgcatgtgtctttatagcagcatgacttataatcctttgggtatatacccagtaatgggatggctgggtgaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgtttttttcttgtaaatttgtttgagttcattgtagattctggatattagccctttgtcagatgagtagactgcaaaatttttctcccattctgtaggttgcctgttcgctctgatggtagtttcttttgctgtgcagcagctcttgagtttaattagatcccatttgtcaattttggcttttgttgccattgcttttggtgttttagacatgaagtccttgcccatgcctatgtcctgaatggtattgcctgagttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcatatggttgtatatatgtggcattatttctgagggctctgttctgttccattggtctatatctctgttttggtaccaataccatgctgttttggttactgaagccttgtagtatagtttgaagtcaggtagcatgatgcctccagctttgttcttttggcttaggattgacttggcgatgtgggctcttttttggttccatatgaacttcaaagtagttttttccaattctgtgaagaaagtctttggtagcttgatggagatggcattgaatctataaattaccttgggcagtatggccattttcacgatattgattcttcctacccatgaggatggaatgttcttccatttatttgtattctctttgatttcattgagcagtggtttctagttctccttgaagaggtccttcatgtcccttgtaagttggattcctaggtattttattctctttgaagcaattgtgaatgggagttcactcatgatttggctctctgtctgttattggtgcataagaatgcttatgatttttgcacattgattttgtatcctgagactttgctgaagttgcctatcagctaaaggagattttgggctaagacagtgcggttttttaggtatacaatcgtgtcatctgcaaacagggacaatttgacttcctcttttcctaattgaataccctttatttccttctcctgcctgattgcccttgccagaacttccaaaactatgttgaataggagtggtgagagagggcatccctgtcttgtgccagttttcaaagggaatgcttccagtttttgcccattcagtatgatattgtctgtgggtttgtcatagatagctcttattattttgagatacgtcccatcaatgcctaatttattgagagtctttagcatgaagcgttgttgaattttgtcaaaggccttttctgcatctattgagataatcatatggtttttgtcattggttctgtttatatgctggattacgtttattgatttgcatatgttgaaccagccttgcatcccagggatgaagcccacttgatcatgatagataagctttttgatgtgctgctggattcggtttgccagtattttactgaggatttttgcatttacgttcatcagggatattggtctaaaattctctttttttgttgtgtctctgcctggctttggtatcagaatgatgctggcctcataaaatgagttagggaggattccttcttttttattgactggaatagtttcagaaggaatggtacgagctgctccttgtacctctgtattctgtacctctgtattctgtattctgtacctctgtattctgtacctctgtattctgtagaattcggctgtgaatgcatctgctcctggactttttttggttggtaagctattaattattgcctcaatttcagacctgttactggtctattcagagattcaactccttcctggtttagtcttgggagggtatatgtgtcgaggaatttatccatttcttctagattttctagtttatttgcatagaggtgtttatagtattctctgatggtagtttgtatttctgtgggatcggtggtgatatcccctttatcattttttgttgcatctatttgatacttctctcttttattctttattagtcttgctagcggtctatcagttttgttgatcttttcaaaaaaccagctcctggattcattgatttctttgaagcattttttgtgtctctgtttccttcagttctgctctgatcttcattaactatttgttgccttctgctggcttttgaatgtgtttgctcttgcttctctagttcttttaattgtgatgttaaggtatcaattttagatctttcctgctttctcttgtgggcatttagtgctatcagtttccctctacacactgctttgaatgtgtcccagagattctggtatgttgcgtctttgttctcattggtttcaaagaacatctttatttctgccttcatttcgttatgtacccagtagtcattcgggagcaggtcgttcagtttccatgtagttgagcggttttgagtgagtttcttaatcctgagttctagtttgattgcactgtggtctgagagatagtttgttataatttctgttcttttacatgtgctgaggagtgctttacttccaactatgtggtcaattttggagtaggtgtggtgtggtgctgagaagaatgtatattctgttgatttggggtggggagttctgtagatgtctattaggtctgcttgctgcagagctgagttcaattcctggatatccttgttaactttctgtctctttgatctgtctaatgttgacagtggagtgttaaagtctcccattattattgtgtgggagtctaagtctctttctcgatctctaaggacttgctttatgaatctgtgtgctcctgtattgggtgcatatatatttaggatagttagctcttcttgttaaattgatccctttaccattatgtaatggccttctttgtctcttttgatctttgttggtttaaagtctgttttatcagagactaggattgcaaaccctgcttttttttgctttccatgtgcttgggagatcttcttccatccctttattttgagcctatgtgtgtctctgcacgagagatgggtctcctgaatacagcacactgatgggtcttgactctttatccaatttgccagtctgtgtcttttaattgcagcatttagcccattcacattaaggttaatattgttacgtgtaaatttgatcctgtcattacgatgttagctagtgattttgctcgttagttgatgcagtttcttcctagcattgatagtctttacaatttggcatgtttttgcagtggctggtaccggttgttcctttccatgtttagtgcttccttcaggagctcttgtaggggaggcctggtggtgacaaaatctctcagcatttgcttgtctgtaaaggattttatttctcctttactcatgaagcttagtttggctggatatgaaattctgggttgagaattcttttccttaagaatgttgaatattggcccccactctcttttggcttctagagtttctgccgagcgatcagctgttagtctgagggacttccctttgtgggtaacccgacctttctttctggctgcccttaacattttttccttcatgtgaactttggtgaatctgacaattatgtgtcttggagttgctcttctcgaggagtatctttgtggcgttctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgtttgtttctttttattcttttttctctaaacctctcttctcacttcatttcattcatttgatcttccgtcactgataccctttcttccacttgatcgaattggctacagaggcttgtgcattcatcatgtagttcttgtgccttgactttcagctccttcaggtcctttaaggagttctctgcattggttattctagttagccattcatctaattttttttcaaggtttttaacttctttgccatgggttcaaacttcctcctttagctcggagtagtttgatcatctgaagccttcttctctcaactcgtcaaagtcattcttcatccatctttgttctgatgctggtgaggagctgcattcctttggaggaggagaggtgctctgagttttagagtttccagtttttcttctctgttttttccccatctttgtggttttatctacctttggtctttgatgattttgacgtacagatggggttttggtgtggatgtcctttctgtttgttagttttccttgtaacagtcaggaccctcagcttcaggtctgttggagtttgttggaggtccactccagaccctgtttgcctggtttcggcagcagaggttgcagaacagcagatattgacaaacatcaaatgttgctgcctgatcattcctctggaagttttgtctcagaggagtacctggctgtgtgaggtgtcagtctgtccctactgggggatgcctcccagttaggctacttgggggtcagggacccacttgaggaggcagtctgtctgttctcagatctccagctgcgtgctgggaaaactgctagtctcttcaaagctgtcagacagggacatttaagtctgcagaagattctgctgccttttgtttggcaataccctgcccccagaggtggagtctacagaggcaggcaggcctccttgagctgcggtgggctccacccagtttgagcttcccggctgctttgtttacctactcaagcataggggcaatggcgggcgcccctcccccagcctcgctgctgccttgcagtttgatctcagactgctgtgctagcagtgagtgaggctctgtgggcgtaggaccctccaagccatgcatgggatataatctcctggtgtgtcgtttgctaagaccgttggaaaagcacagtattagggtgggagtgacccgattttccaggggctgtctgtcactcctttctttgactaggaaagggaattccctgaccccttgcacttcccgggtgaggcaatgcctcgccctgctttggctcatgcttggtgcactgcacccactgtcctgcacccactttctgacactccccagtgagatgaacccagtacctcagttggaaatgcagaaatcacccatcttctacgtcgcacacactgggagctgtagactggagctgttcctattgggccatcttggctttaccctgatttgcatttctctaatggccagtgatgatgagcattttttcatgtgtcttttggctgcataaatgtcttctcttgagaagtgtctgttcatatcctttgctcactttttgatggggttgtttgtttttttcttgtaaatttgtttgagttctttgtagattctagatattagccctttgtcagatgagtagattgcaaaaattttctcccattctgtagggtgcctgttcactctgatgataggtccttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataagatgtaaggaagggatccagtttcagctgcctacatatgggtagccagttttcccagcacctagtttgagattctgagggtaattaactaaatatttgtccgctgagtactagaaatacagtacacagaactcgttgcactgtaagtggaaaatataccctaaaatatactctggattttgaagacagtttgaaaaaatagaaaatattaacatttaattttgattatatgtttaagtgataatatttgaccacttatttattttttctttttgaaatgtgactactaaacattttaaaattacgtgtggcttgcattatctttctattggataacactgacctagacaaagaaattacatttgataggtagctcctgcccatttggtagatagttcatgggctttatcaggctttagaatcaagaggaggaagtatttgatgaaaattcatatacagatagttatttaattaattaaattagttaacatatataaagttcttagtacagtacctggcaaataatatgcactaaataagtttctttcatcaattatatgtgctaaaaaattttctttcatcactgtaattcttgttagtactggtaatagaatagggaggatagaaagtgctccatgaaactgtccgattgacgatggacttactgtgaattaaaaatcaaaaaagaactgagaagttaatgaatgaggcaggaacagagggataggggtgttgaacattgagtgtttcccaagtggctactggcatatgaagaggtttcatattactaggtctcccagtatgtgtctctggctttgcaggatgtgggaggatatctctttgtcatagaagtggaggttcgtagggaggaaggatgaaagcaatgaaggaaggaacaaaataacacagagaatgctctgaactaatagtgaacacattccatataaactcatcctgttattcaagcaggattaacttcttcaagtggcattgatgcttcaagtggcactttaccttggatgtgttttctatagtggaatttgggggcaacatgtcttttataacagaactctattggttaaaaatatttgtaaaccacctccttatggttaaaccagatagatcttcctgttttcaattaaataggttatgtctttcaacttctgtatggagttggtatatttatgcaatgagatggacatttgttcctttcctttcctgtcctgtcctgtcctgtcctgtcctgtcctgtcctgtcctttcctttcttgtcctgtcctgtcctgtcctgtcctttccgttctgtcggactttcgctcttgttgcccaggctggagtgcaatgacgtgatctcagctcaccgcaacctccgcctcccgggttcaagcgcttcttttccctcagccttccaagtagcttgaattacaggcatgtgccaccacacctacctaattttatttgtatttttagtagagatggggtttctccatgttggtcaggctggtctcgaactcctgacctcaggtgatccacccaccttggcctcccaaagttctgggattataggggtgagccaccacgcccagctggacatttgttttttttctaactttaatgtgtgatctgcagtttcatcagactaaccctatttcacaatccttactttttgagaaaataattaatgctaacttttccattttaaaaattaaaattttataacagatatatgcatagacatatttttaaaaataaaatagtaatacagagtccacaaagaaaatcaaaagtcttctcatgtttatccactactcagaggtatccactgttaaccatttatgtttcattcttagttatttttatattttaaaatgcttatattgctatgttttattttagtttaaaaattatttctccatgctgagaatacaggagatcattgctcacacttcccccttactttccctcttcttccactctttgataattataagaccattttacttcttgtactgcttacttctgttattttaaataatatacttaaactcttatttcttatttcatcaacttttgactctagctttgtaagatgaagatattagcacttctgtcttgcttaacccttttagccctcaactcccatcaaccacaccttcatttttcattttaggggttataacattactattctagtctggaaccttaatgtaatcttattgatattattaatagacttatttgacagtggcaaaaagaagtggacaatccaggatttgaacccaagttctttggctgcgagtccatgaattttgacatatcttatattgggttaatgtaagagttaatttctggagccaacgatagatgaaggatgattcctttctttgcccctttttcctaatttcttctctactatgtttaaagttctttgagcagccacactctagatttctttttggttcactcctatccctcccacctctcaaaattcccaacacatgcaaagtttgtgcatccttccccatgtgtacactttatcacttgatttgcagaactgttctcaccactattcgccttcctataatcatgcaacttccccgcctccccccaccgacttctctgacccaagattaagggaggacaagcaagtcttagtccagctctgtttataatgggtctttcatcccgcagtgtagaatgctagactgtccagtagggatggcagaataaagactcagtcatcccctctagccttatgacagggagggtatttgtaccctttgattcatattttttgggtcttgtcagagttgcccacagtatgatgttttcagttctttttcaagggtgcccttgccagagaggaacagccactgaattgagcttttttgtggtttctggtgggaccagggccaaattgtctgactaagacatctgagtctgcatttaacccacttcatggagagtgggagctagtgtggaagctatgatatagtgtgttctcacccaagagatggcaggcaagagggcattgatgacaggacatgggattgtcagtcttaatgatgtttctcatccatgtacagttatcacagaaagaactttaagaaaaggacctgttctggaggtagatgagactgaaaacgtatcaaagatggcacaaacctgacagtgtagatgaagacaaaggtgttagtgttggtctgcattccaaaggccagtgcttgctctgggaaagaggggaaggaaacatcagcaaaccacccattgatagatccaaataatttgaatttccatgtttgggtttcaatggctaccagagtgcattagcagggaagatcaagtggccaaggtgctaaagaattaagctatgtgacagtaatccgtaagtgatttccaagtctgtagcaaacattttataagccttacaataataactaccatgtactaggtacttggtttatgtcctttcaattattattatttgtatcctacagatgtggaagtcaagacccataatggccaaataacttgtagaaggacacatagttattaacagaagctagtttaaaacagatttttgttactccagggactgtgctctttctactaccctgcactctgaaccctgctttgtggggctcgtatcagaagattaaaaaaaagattaataatgcctgtcaccagttcaatggatatatacattgtggcaaattgtcattattctatagcaatgagaacaaatgaactagagctgttgttcaccgtaacatagatgaatctgagaaatacaaggttgagttaaaaaaaaacagtcacgaaagattacctgctatatgagtccatttctataaagtgcaaaaacaggtaaaactaagtgatgatgttagaagccaggttagtggttacctccaagagtcggggtgttactgaaaaaaaaaaaagaatcacaaaggggctttcaagggttcaggtaatattttgttgttttgaccttgggtgctgatgacatgggtgtgttcagtttgtgaaaattttttgacatttgtatagtgtatttttcagagtatatgttataatttcaaaaaatggaaaagaacattagaaaaccttaatatctcctttgtagcaccttccaccagcaatccgtgtttcttcatacatggagacaatggctttatgggtttatcctcctgattatcctcatatatggaccttcttcctctatgatgactttccttcccttttatctcataggtgaatttccctaagcagtatatagtattgttttacataatatactggttaagacagtggactctggagccagactacctgggtttgcatcttggctcttcaacttagtagctggtgagtgtaggcaagtcacttaacttctttttgccttagtttcattatctataatatgggataaattatagtacttaccacatagagttgtggggataaaatgccttattatgtgtaaaatgctcagaatagtttggtacatatagtacataacatacaaatgtttgctactactgattttcatatttataaaaaaggaatgatctgcaggtgctcttttatatattgctttttttctcatgatttcttaaacaattatcttttttttgagacaaggctttgctttgttgcccagggtggagtacagtggcacaatcacagctcactatagccttaaactcccaggctcaagcaatcttcccattgcagccacccgagtagctgaaactataggcatgtaccaccaaacctcacaaatttttaatatttttgttgagatgaggtctccctgtattgcccagactggtctcgaactcctggtctcaagtgatcctccagccttggcctcccaaagtgtttggattgtgaggcattgtgccaggctcattctcttattgatggatgagtcatttgcttccattttttatgtgagtgcaaacaatactcctgtgacagtgatttacatgtctccttgtgcatatttcaactcttctcctgggtatatacttagaaatagaatttctatgttgtagaatctatgcatttttactagatgtgttgccaaattggtctacaaaatggttgtgtcaatttatatcatcactcatcactagcagtataaaagtgttttatttgctgcatatccaaggaaaatgagttagttcagaaagatgcaagagaatttgattcagcaagtgtgtattgtgtctctaatctgtatatagagaaggaagcagtcactggtggaagagaaatttgctgtacagacacagagcagctctacttaataccaaccacatatgtaaagtatctggcatagagtaaacccctttgctcaagcaatctgggaatgtacccacacagctgatgtggtaatgttattaccctcttacaaggtaatctatgtctgaaaaataatgtggcacatatacaccatggaatactatgcagccataaaaaatgatgagttcatgtcctttgtagggacacggatgaagctggaaaccatcattctcagcaaactatcgcaaggacaaaaaaccaaacactgcgtgttctgactcataggtgggaattgaacaatgagaacacacggacacaggaaggggaacatcacacacaggggcctgttgtggggtggggggttggaggaggggggaggggggaggggtagcattaggagatatacctaatgttaaatgacgagttaatgggtgcagcacaccaacatggcacatgtatacatatggaactaacctgcacgttgtacacatgtaccctaaaacttaaataaataaaaaaataaataaataaaagaataatggccacatttagcctgaagagtagagggtggaaagggaatattatcttgttgtcagtgacatagaatggaccatgacccaggatgaggtcatattttttccatctcccttgccatccttcactagagtagaagggaattgcatcaaagagcggagagacactagttttctcttcccgtctataaccaaagtgaaactgttatctgccccttctccctatcccggtgccctttctacttgaactatttgagagcatttttgtaattacaagggtgatctcgctgaaatgaggtttccttttgtgagcttgtaactcggttcctaatattagctggcttcaaagtcatgtctggagttgacaggagatacaggaaatcaagagcatgtatctccctaaattggattgtaatttggggattccctgtttttggaggaaatgtcaaatgttctatatctgagttttccactacaatagcttctagcaacgtgtagctactacatacttgaaaggttactagtgtaactgaaaaactgtattttaaattttagttgattttagttaatttaaggtaatgtagccacctgtggctattggtagctgtgtaggtctaataaatattttgttggtagaggaaggtaagggagctaatatttttttttcagtacctgctatgcattggggtctatactgccatctaatttttacagtaccctgtgaagattttatcccccattttacagaacaggaaaccagagctcagagaggatgacctacttgttcaaggtcacacaggctacaaaatggcagagccaggatttaaatacaggtctttctggtctctccaattccaaagtccattctctttatcctgaacagggtggtataattttgttcttgctacttggcttcagccatatgccagaaaagcttaaaattgaatgccttctaacagtaattccatattcttaactgttaatttgcattagcaaatgggtttctggaagctctaataaatgcataccttgcagatattgtgtgttcagttccagaccattgtaatgaagtgaatagtgcaataaaatgagtcacaaaaattttgctttccaagtgcataaaagagttacatttacaccgtactgtagtctattaaaggttcaatagcattatgtctttttttttgtctttttttttttttaattttttttgagatggagtctcgctctgtcacccaggctggagtgccatagtgcagtctcagctcactgcaacctccgcctcccgggttcaagcagttctcctgactcagcctcccgagtagctgggattacaggagtgtgccaccacacccagctaatttttgtaattttagtagagacggggtttcaccatgttggccaggctggtctcaaactgctgacctcaagtgatccacccacctcggcctcccaaagtgctgggattacagatgtgagccactgtgcctggccctcaatagcattatgtctaaaaacaaaatgtatatgtaaaattaaaaaacaaactttattgctaaaaaaatgatgctgacacagagacatgaagtcagcacatgctgttggaaaaatgatgctggtacacttgatccatgccaggttgacacaaaccttcaatttgtaaaaaattcagtaactgtgaagcataataaagcaaagcataataaaaatgaggtgtgcctgtatattaagattccagggactttggtaatgatataggagttaagaagaaatcacttaggcagatagtaagggtataggagtccttggtaagacttttctttttaatgaaaagcagcctcaaatcattttctaacaatgcgcagcctgtaaagtcgagctgcagacatagacaagcaagctgagagcttgcatgagtgaatgctggcaggaactagagactagatatgttcaagatggctcctccatcatcctttctctgccagccatgtgtacagtaagaagcagacaagatagtgcccgccaaggagaattcatttgtggaataagattagggcggtgagaccagccttccccttgctcctgatcaaaccaatctgtgagccctacctaaatcagacactacctcctcaagctggaccataaaatctggtgcattcgcagtgagcaggtcctttccttttggagacccccctctctctgtagagagagctgtttctctttctcctctcttctgcctgttaaacctctgctcctaagctcctcgtatgtgtccgtttcctaaattttcctggcaagagatgacaaaccccagacaacacagccacttcagtaatgactttctgtcctaggatatttgggaggaataataaatgcctaggaacaaagtgattgaatgagtcagttaggctttttgtatatttttagtcaaaaatcattataccatgtcttagggttcttcaaagagacagaacaaggggtgtgtgtgtgtgtgtgtgtgtgtttgtgtgtgtgtgtgtatgtagagcggggtttagtttaaggaattctcttatatgattgtacgggctggcaagttcaaaatctgtagggcaggctggcaagatggagactcagggaagagttgatgttgcatctcaaatccaaaggcattccctcttcctcttcctcagtcgtcttcctcagtctttttactcctgaggcctttgactgattagatgaggcccacatatccgcaagactactggtttaaatgttaatctcatctaaaaactatttctaagtaaatatctagactagtgtttgagcaaatgtttaggtaccgtggcatggccacaatgacacataaagttaatcatcaaacactatgagaacttttgttgttgatttaattactttccttttccgtattcacataacttttatttcagtatattgttataatttttgttgtgctattttagtagttattgttgctcatctcttactgtcgctaatttataaatttaactgtatcatatatatgtatgggtaagtgacttaagaactcttgaggcaggcagttagaagtttcagtcagtgtcctccaggtcttttctccgtggttctcttagacttcacctcagggtcataagatggctgtcacagctcaacatattacatactcacatgttagcatcccaagcagaaaggaagtgggggagctcttttttttttttttttttttcttgaggcagattctcgatctgcctcccagtctggagtggtgcagtcttggcttactgcaacctctgccttccaggctcaagcaattctcatgcctcagccccgcccaggtagttgagattgcaggcacatgccaccacgcctggctaatttttggattttttggcagagacggggtttcaccatgttgcccaggctggttgtgaactcctgacctcaggtgtttgggaagccgaggcttcccaaattgctgggattacaggtatgagccaccatgcccagccataaagggctcttttcacatggcatagtttgtcttttatccaagagaaaaatgtcttaccaaagttgccacctgactttccctaataactcattggcaatagcggagttgtgggcccactcctaggacaatatttaggaaaaagacataggagtactaaaattcccctttggcctgggaggggggctcacttttttttggagaacgttgcttgcctgcctgatatctgaagaaataggaagaaagaggatggctattgaattggcaatgaacagtgactgtcataatggccttttgagaatagagatgctggactctaaccaggagcctctggaatatattcaaagggcaggaaagagaaaaatactggttatctatctatagtactttaatataataatcacagaggcactttcaccatatcttgttttccaaagagagattgcctcaaagacccagagagggaatgtgacacctcctaggtcctacgggaagctagtggcagagcaaggaataatactcatattcttttgctaccttcatgctgcttgtaccacttttgttcctccagcaggtcttaagcactgttccacagtgagcaggtctatgcacacctacccctgaagtctaagaaagctgagaggcttaagaaagaagctgacatatccagtttctgagagagaaacatgtaatagatgtttacaaatagaagccatagtcttgggcagcagtgagacaagatggtggatccctgtgccgttaccccctagacgcagggcgtacataccacagggacggaatgtgtaggacaattgaagttgacctgcccggcaaaggcaagaatgctgtgtgaatctttctaagggcaggatctatggtcaaagttattctgatctacgggcaagactgataacagtagataaagtagaaatcttagaggcatttccagaacagaggttaatcagaagtcaatatagtagatttgcatccaagatggagttgctttagcttctacaggcactttaagaacatatttggcagtgatttctgcctatatgatgtaagcatattgtggtttaaaaattttaaaaaatttaactgaaattgacttattactatccatttatattgtagcttacatttagcagcagaagagaccttcaaagttattagtcccacctcactttacagttgggggaactgaggcttagaaggttaagtgactgacccaggagcatagatggttagcaggggagatgggatcagaacccaggtcgcctgattcctagtcagatgtaatcaccagttcttcagagatattccataaatataatattttgggcagagctgtatgagttttatttttgttcaaattatgctgagataaccttgtagacccaatgtcttggccctcatttaacccattcctgctttagccatttctcttcagaaagaatcagatgcacctttttgcatcacagtttccttatctgaaaaaaaatgaggataatgaactatatggtttattttacttataaagttctatgattaatacaagccaagactagagcctagctgagtctccagatttctgttttgaaaatcaaggggtgtatttttattttaataaactactaagccaatatttatccagacaacttagttaatataacttttttttttacttgcttgttttttaaccaaagtgggtgtttaaaaatttgtctttcaactggcactatgttgtcagtctcaccaggcacagcaatcttcgaggaggtccatcttccaaagccagacttcctctaaaaaaaaactccccaggaaactggcttctgctcacagtaggatatgcatgtccagaggattttttttcttatttacttatgtagcctctgtgtgtgtgagataaagctgcttctcacttccgttgacaattaggaagtggctggcattagtaggcaagtaaggggggaaaagccctgcaccccaaccagaattcaatagttaaaaggaaattgttatattgttttcaaagcatttactttcctctccttgattgtatcaaggaagatgccaattcatcatcatcattgctattcttatgaaacactcaatatgtattaaatatttatcatgcaatctcttttgagcctttcgacaactctatgatgcagtccctactgtaacatttattttgtgaggaaactgaggcaggaaaataagaactttaaacaagctggtgtttgagttcatgggtaaaccctctcattggaaaatgggaaattgttggtagatgatgttgcctgatgatatgtatggcgatttaatttgggctcagatttttagttctttaagacagtattattgccaggaaatacttttctgagaaccccagaaaaccttgcatattggttagatatcataagaataacataacaaagcatcccaaaattcagtggcataaagcaataagcatttatttctggctcacacatctatgggttggctgaggtagctttgttttttttcaattaggttcgatggggcttggctcaggccacaagttccatttaggtctgctgtatgtgtctcaatttttcagggatcagagggtcacctgaggcagattattctcaggatggtggcagaagtgcatggtgggtaagcagagacacgtgaggtctttcaaagctaggctcaaagccagcctaccattgcttccttacaaattcagttggccaaaacaaatcatatggccaagcccaacatcagtaaggaggtgaaatacattcttcctttagcagaactgcaaggtcacatggcagagtacatggatacagagaggtggggggaaatttgggaacaataattcaatctgccatgccttggctgaaaagtagtggcagtaggaagtcagaagatgagagctagaaaagatactctgatggagagtgagaggtgtagtgggaagatccttatggttaggagatctggttttgagtcctaactgtgacacttttttagtatgaccttgaacaagtcattttccttgatatttgagcattaagggtccatgtgatgtcttcatcttatattttcacttacctagataaggatgtagagtaaatgaatgcaatgattagtctatgttcaaacagctaggttgaatcagtaaagactggaactttgagttctttttccattcctcaatcttcattgctttagaagaatagttaatatttgaggaggggccaggtgcggtggctctcgcctgtaatcgcagcactttgggaggccaaggcaggtggatcacgaggtcaggagatcgagaccatcttggccaacatggtgaaatcccgtctctactaaaaatacaaaaattaactgggtgtggtggtgcgtgcctgtaatcccagctactcgggaggctaggtaggagaatcgcttgaacctgggaggtggagattgcagtgagccgagattgcgccattgtactccagcctggcaacagagtgagactccgtttccaaaaaaaaaaaaaaaaaaaaaaaacatttgaggaggggtgttgggagaggtttcagctctcctccttttctcatgaaattaaagctgttttactacaattcttctttccacattaccatgcttatctgttttccatttcttcaaagccctgaacaaggagaagtaggccaaaatcataataggaagaactgaagttcaggcagagtaagtgctttttgcatgtaactgtacttaaatgttatatattgttagggaaactggtaacattgctgtccccaaagatcttttagagaggcatctgttgctatgtgatgtgttaagtggagttattcctgaaagaagcacagtgggctagatatgactcatggcctcttctgtctttatgctattataacatatttatatgtgtttatttgtcagacattcatatcatgctcatatagtgccagatattcttctaagaagtctacaggtactaattcatttaatcctcaaaactatgagacagggagtcttacttatttctgttttacagattaaaataaacgcaaataccaaacacgaacaaggaacaacagcaacaaaaacctaaggcacagggaggtgacataactttggcacagtcaagcactagaaaggagcagagctggtacttgaacccaggttatgtgattccagagtccacgcctttagccacgtggcacataggcatcagaactgagcaggccaactctgctacttactagttctgtgacatggagtgaagtacttcactcctctgagccttgttttcaactctaaaatgtgaacaataattatatcagcctcacagggttattgtgaggattcaatgagatagtgcataaaaccatgcttggcattgaaacattagttctatttccgtgaaatacttctatacattttaaagatgactttataagtcttccttttaacttatagtttatgaactcttacaaggtttataatccttggcttgattgatttatctgtatgactgattccttagcagtctgtaagacaatttggccttgccatttctgtctaacataggaaaagagcaatgaggcaatttcccttggggcggagattaagagccagtgaccccatgtatcttggctgtctgagaagttgctgaactgtgccatctcctttttccacatttatccttaccttaaaaatagtcatgaatctgaattttgtatatagtgttgaaggtgaatctgacattatagtttttagagttctcattcattatgctcgttattttttctcttgacaccccagcaagaatttaggaaacctttgctggagtgcccttgtgaagaaaggccttagtttgttacatgccaaagtaccatgtcctgctgacaagaagcgttctcctcctatacaaagagtgatacagtattcactcagagctcacagccctgcctgttccgcatgctgggatcctcggggactggtgcaagtgggtggaggaggttatataagctcacatctccttccaagtgggaagaggcgagggacaacagctgtcagctccacagctggtcttgccagcccaagtgattccaactttatttgatcagagaagaaggcttctcagtacacagaggggagatttgctgatccagagccaatgttttaaaactttggcaatttgtgctaacttcctctggctaggacagatgcttattggctctggctgcctggacatggtgttctcgaggcattttgtgtcatcctgaattgggcccagccagctgctcatctataggagattctcaaggaatggtgcaaagctcattacccttagacttttggttgggcagttgctcttgcatcagtatccatttcattacattaaactaaaagaataaaataagttctcaaaaggcagatataaaacacagcaatctccataggccatttttttatttttaattttttggggtacatagtaggtatatacatttatggagtacatgagatgttttgatacaggcatgcaatgcataataatcacatcagggtaaatggggtattcatcacctcaagcatttatcctttgtgttacaaacagtccaattatactctttattttaaaatgtataattaagttattattgactatattcactctgtattgctatccgatagtaggtcttattcattcgttctaattttttatactcatttaccatccccacctccccatcatccctccactacctttcccagcctctggtaagcatctttctataccctatgtccatgagttcaattgttttgatttttagatcccacaaataagtgagaacatgtgatgtttgtctttctgtgcctagcttatttcacttaatataatgatctccagttctatccatgttgttgcaagtgactagatctcattcttttttatggctgaataattactccactgtgtacacatactacattttctttatccattcatctgttgatggacatttaggttgcttccaaatcttagctattgtaaacagtgctgcaacaaacattggagtacagatatctctttgatacactgatttcctttctttggggtatgtacccagcagtgggattgctggatcttatagtagttcaatttttagttttgtaaggaacctccaaactgttctccatagtggttgtactaatttacatgcccaccaacagtgtacctcagttcccttttctccacatcctccctagcatttgttattgcctgtcttttggatataagccattttaactgggtgagatgatatctcattatagttttgatttgcattgctttgatcaatgatgttgagcatcttttcatatgcccgtttgccatttgtatgtctttttttttttgagaaatgtctattcaaatcttttgcccatttttggtccagttttcttttctgcttcaataggaaagcactgagttcaatgcatcacaattgctgtgttctccctcctccagcagccagagatgttctctgaaacatgctgctgctgccaggagttggcagggtggtggtgtctgcaattctggactgttttatctatctcctcagtgtcctttcggcgatatgaagttacaaccaggtactttgtactatgagtgcttacatgatttttggttctgatgaaggtatttttttctgtgtagatagttgttaacttggtgtcactgcagtggagggggacaatcggtggagccttctatttcgacatcttgctctgcatctttccacaataattggcaatttattcttttaaaattttgagatgagtggagtgcagtagcgtgatctcagctcattgcaacctcccacctcagccttcagagtagctggaaatacaggcacaccccaccatgcccagctaatttttgtgtgtttttttttttttttgtagagactgggttttgccatgttacccaggctggtctcaaactcctgggctcaagcaatcctcccgccttggcctcccaaagtgctgatattacaggcatgagccactgcgctccacctggcaatttattcttgatttactgtaactctgggaaggacatggctagcacataacttaatgtcaacatttctttttacaactgaaaggaatattgggcttttgggatgcatctcttgtccttggtggactataagggtgttgaaagccagttgtaatggcctgtcctctgtagattcccctcagaactaagtctatgcctgttacaagcttagttactatatttatagctagcacagataagaaatctatgtgatggaatattaaatttatgcctgacaagcaaaactatagtaaagagaaaatttgcctacggccttaaatactttggagacagacaaatttacaaggacagtatgtgaggtcggggttataatatgatcgtgtacacagagagagtacaggaaggactgcaaacaaagataggatatggggatattgaggaagacttagagaagacaccactgagaagatgatacatcttcttgtatggaatcttgaaggacgatttgaaattagccagtgaagtggagtgtgaggtacaaggatgctaagtggagggctcagcttgtacaaagaaagttttcaaagtacgcgttgccatctcatgagggatcatgtatatcctctcaaggtgagtatacttagtcctgtagttgatatggaacgctttgcagcaggggaatgtagtaaattttagatagtttaacccacctcttactggttttttgcattgggtaagatatttaatcttcctgaggtttagtttcttcatttgtaaaacagtactactaaagtttattatacagcaactttgatcattaaatgggggtcaaatatctagactatgcatagtatattagagctactcagaaaataacagattctcttctctttatactcatgtttgatttcctgtattacattatattttaatttagcaagtgtatcttgagcacccattttcgcctatttcaatgctaggccctagggatggagttgaataagataccgtccttgactttatggagctacaagttatgtaaactaactattctaaccacaagaccatggtttcttgtctcctctgtgccactgggcaaccatcgacccactcattttctagccttctgcaaaactcctctttatcctcacctatctttgcctttttatctctcatcccagaaaacatcctggcccttctcctgcccatagatgatctcttcatttgggttttttatcccactccttgtattttcttattttttctccctccatatagcaacacacttaaatccctcttgcattaaaaacagagccccattcttactgtcaaggcctggaaggactacagcataacagttttggctaaatgatgatagtcaacacattgtagcaataggaactcaagagttgacattattttaaaacggaggtatggtacctcaggatggttttttagcagggagcaaggtgcttagttcagtggtggtaggaaggggataatggcaagtgtcaaagttgtccataaccggccaggcacagtggctcacgcctgtaattcccgtactttgagaggccgaggtgggtggatcacctgagggcaggagtttgagaccagcctggccaacatggtgaaaccccgtctctactaaaaagacaaaaattagccaggcctggtggcattgcacctgtaattccagctactcgggaggctgaggcaggagaataacttgaacctgggaggcagaggttgtggtgagcggagattgcaccattgcactccagcctgggtgacaagagtgaaactccaactcaaaaattcataaataaataaataataaataaagattttccataaccaaatatgatccagttatagagggcatgactatcaatggagggtgtgattcacacaaaattcatctggcactcaagtggtatgcaaggtagagactgggaattctgaaccagatagaagtcctgatgtttcaaatgggacacaaagtcagagtcaggctggtagccacattgacatgacagtaaatctagtgtatggggctggagttcttaatctaccctgtctcattgtagacttggtctcagcaactagagccaaggtagacctatatgagcaaattaagtagactccactcttgaaagaagaaacgagtctgctaaatgccttactatttaaataaggaaatctttgagaaagtatgttttatatagaggaaatcatatgaacaaaaagcacagtatgaaaaagtgtggcatatttggggaacatatagtaatctggtgtgattagaatatacatgtttcatacaaggagtgcaagaggtgaaactggagagtagattggcgtgagactgcagggccttgaatacgaggctaaagagtttatacttggtactgagttaagtctactagtactgtcttatacctggtgtctgtgggatctcatttaggggtgtgctgtgtccttaaagcatttccttagtgcctttccttataaaatatatggtggtttcttcacaaggttatctacttctacattgggaatattgagagtcagaaggttaagatttttgtttaaggtaatgtaagtagtaaatggaaaatgcagaatttgaacgtggtttagtgccctttcctagtatataacctagtatattgtcgaggttagaagtaagggctttagagtcaattatgggtttgaatctccatttcttttacttctattagcttgtgcaactttggaacagttcgttttctgaggctcaggctcattcctcttctgtaaaattgggataagaatagtaacattcacaggcttgtatgaggattcaaagaggtaatgcatatcaagtgcttaacataacaacttacaaataatactcaataagtggtaactatttctagtattacattaaagttatattggaaaaatgtgtttttacttgaaaaagttaactcagaatatgtagaataaaaggagttgatccagtattctgatgttatagtcatatttggataggaattcatgcttgttctgcactgaggttgcaaatttgcttcatgtgttcattcactgattcactaaacagatgttaatttggccacactctgtacctgacaccattccttgtacaatgaacaggacagatgaagtctctgcttatgtagaccttacattttagtggtgtgccagagggtgggaggcagatgttaaacaaataattagataaataatttcagattgcaacaaatgcaataaatgctttgaagacaataaaatcggtgattcgatgttacttgtgggggtggagttggtctagggcaactttagaaggagtcataatggacagcctctgaaaatgtgacacttcaggtgtgacctgaacattgaaaagaagccagtcatgagaaaaattggagaaagagtgttctagtcatggcaagcgcacaaaggtcctgaggtaggaacaagcttagtggtttgtctaaggaactaaaagaaggccattgtgtctgaagtgaacactgatgagagagtgttctggcccaggccagatcataggggattttgtaggtcatagtaacaactatggattttatcccaagcacagtgtggagtcctggaagtttttaactgtggggaatgatatgatcaatttatatgtttttgataataataatagcttttgtttattggacagatacagtgataagcacattacatgcatatatttcatcagtcttcacataacccagtaaaatatgatgttatttttgtgattattttagagattaagaaatctgaagcttagtaaggttaattttttaaaggtcacaaaattattgttatttatagaaccaagatttgagtttgagtttatctgatcctaagcctacatggcttttattaagctaaaatatatataacaggccaggcatggtggcccacacctgtaatcccagcactttgggaggccaagacgggcggattactcgaggtcaggagtttgagacctgcctggccaacatggtgaaaccctgtctctaccaaaaatacaaaaattagctgggcgtgatggtgggtgcctgtaatcccagctactcaggaggctgaggcaagagaattgcttgaacctgggaggtggaggttgcagtgagctgagatcgtgccactgcactccagcctgggtgacagaacgagactccaggtcaaaataaatacataaataaaatacatataacaacattggctattttaatcattttaagtgtgtaattcagaaatattgattgtattaaaaatgatatgcaaccatcaccatcaaatatttccaaaacccttttatcaccccaagcagaaactctgtacccggtaaggaatgactccccattttccccagccctggtaaagtctaatttactttctgtcttctctatgaattttcttattctagccaagcttgctggctcatgactgtaatcctagcactttgggaggccgagatgggcagatcatgtgaggtcaggagtttgagacctcagccaacatggtaaaaccccgtctgcactaaaaatacaaaaattagccaggtgtggtggcacatgcctgtagtcctagctacgtgggaggctgaggcaggaaaatcacttgaacccaggaggcaaaggttgcagtgagccaagatcgcaccactgcactccaggctgggcaacacagtaagactccatcttaaaaaaaaaaagaattttcttattctagatatgtcatataaatgaattcatactatatttctctttttgtgtctgacctatttgaattagcataatgttttccaggttcattcatgttgtagcatgtatcagaagttccttcatttttatgggttaataatattccatctagtgtatataccacatattttttgtccatttatcaattgatagacatttgggttttttccaccttttggccattgtaaatactacagggaacattggtcaccaagtatctgcttgagtccctgttatctattattttgggtatatactttggagggaaattgcctggttatatggtaattctgtgtttaaatttttgagaacatgacaaaatatttacctgggtgcctgtaccattttactttcccatcagcagttcacaagagttccaatttcttcacatcctcaagaacacttattttccacatatataattttcatttctaatttttttatagacaggatctcagcctgtcacccaggctggagtgcagtggcatgataatagctcactgcagccttgcattcctgggctcaagagatcctcccgcctcagcttcctgactagctaggaatacaggcatgtgctactgcatccagcttttttttttttttttttttttgtagagatgggggtctcaccatgctggtctcaaactcctggcttcaagcgatccttctgctttagcctcccaaagctctgggattacaggctattttctgtattttttattttagatatcctaataactgtgaagtcatatttcattgtgattttgatttgcatttccaataactaatgatgttgagtatcttttcatgtattcgttggctatttctatatcttgtgatatggccatatgtctattcaagttttgctcatttattttcttattgttgagttttttctttttttgagatggagttttgctcttgttgcccagactggagtgcaatgacgcgatctcggctcactgcaacctccgcctcccaagttcaggtgattctcctgcctcagcctcccaggtagctgggattacaggcattcaccaccacacccagctaattttttgtatttttaatagagacagggtttcaccatgttggccgggctagtcttggactcctgacctcaggtgatctgactgcctcagcctcccaaagtcctgggattacaggtgtgagccaccgtgcccagcctcttattgttgagttttaagagttcattttatgttttgcatactagacctttgtcaaatatatatgcataattgtgtataattttatataaatgtgatcatatagcgttctgttttgtaactttttttaatactcactaatatcatggatacccctgtaggtcaataaatgttctcttacaatttgtaatgactcataatgttccattacataaatgaattataatttagtttgtttttatttctttgttccactttgctattattaataatggtatagcaaacattttcgtgaaacatgaactgaagcagatagaacagcaatttcattggaactttttaacatttgcctttctgaaactgataataattgcccaggaaaaataagtgacaatatcaaaatcttaacaatacaataagtttgagctattttatttacatagaatacacagaactttgtatccaagaaacagggatacatgttcttttgggtacacagacaacattaagaaatataaactatgcatcaggctataaaggaagcctcaaaaattcaaaagattctatatcacatagagtatgttttctaaccataagaaaataaaattaaaaattaatgataaaacattccatatttgggaactaacaaaatggcaaatattctttgggttaaaaaaataaatatattttatgatgaaatgacaatgaagtcagtatatatccacatttgtgggacacagttcattatgtagaaaggaagttcattgctttagatatattgatcaacaaataagaaagattaaaaacaaatgtattgagcatttaaattaaaaaaattgataacaacaacaaaacctacccgaagtgacaaaacagctggacatataagacttaagggcagaagtgaaataaattaaaaaacaactataacaataaaaaatggtagaggtaattaacaaagccaaaaattagttattgaaaggattaacaaggtagactggtaggaaaatgcaaacaaacacagtagagaatatagagtaaaataaatgaaatattacagacacaacagatttgttaaaaagacgaaagaattataacacatttgaaaaaaaagagatgaggttaattcctagaaaaatgtaaatggccaaaagttggcaaaaggaaagagggagactgagtagacggatatatattaaagatattgaaatggaattcatacttcccctccccttcactccctcagaaaaagtggtccccaaaaattttaaccttagaaatgagtcggttcaaatcctttcattactagtgtaaaggagaaaaacatgtgcttattgtaatcaaattagaattgcaggaaaattaagtaaataatatttatatgataacctatagcaaacattatactaaatggagaaactttaaatatgttcatcttacgatggagaacaagagaaagatacccatttgtctactattgtttaacccagtactggagagccccactaatactgttagaatgaaaattggccgggcgcagtggctcatgccgataatcccaacactttgggaggccgaggcgagcagatcacctgaggtcaggagtttgagatctgcctggccaacatggcaaaaacccatctccactaaaaatacaaaaaattagccagacatggtggctggtgcctgtagttccagctacttgggaggctgaggcaggagaattgcttgaacccgggaggcagaggttgcagtgagccgagattgcgccactgcactccagcctgggagtgagactccttctaaagaaaaaaaaaaaaaatagaaaaggaaagaaaattaaataagtgcacaaagatgggaaggaaagatttaaaattggttactatttgaaaaacattacaaaacagcatggtgttatttgcagatgatataattatataactgggaaaatcagcagcatcagtaaactttataaggactaataagaaattcaccagattggcaatgacacgagtaatttgccaaagttaatattatttttaatacgtgcaataagtaaccagtaaatgtgataagtaatattgatacgggaggggggcaggcaagtgctaggaagagaaaggcccggtccctggctagggctccacccctgggcctgtgcccacggacctaggtgaggacaggcatttctgttttcatgccaaaatgttgcattttccaagaccaccctggcccgccatgcccccatcctttgcctataaaaaccccaagaccctagagggcagagacacaagtggttggacatcgagaggaacacacaggcggaagaacacagccgcagacaccagcagataccaggaggacaccggcagacaccaggaggacaccggcagacaccaggaggacaccggcagacaccagcagttgccagcaggtcatctatggcgggaagacgctgagttcagccgagggcggtcagaggagaggcaggagagctcggcggctgagcggcctgactcctggggaaaaccaacttcccactccatcctccttctggctccccatccatctgctgagagctatttccatcattcagtaaaaccttgcactcattctccaatcccatgtatgatctgatttttccggtacaccacggcaagaacccgggatacagaaagccctctctccttgtgataaggcagagggtctaatttagctgattaacacgagctgcctatagacaacaaaactaaaagagcacactgtaacgcacgcccactggggcttaaggagctgtaagcatttgcccctagatgctgccttggggttaaagcccacatgccccacaacctgcccatctgcatgcgccccctagaggtttgagcagaggggcaccgaagaagcgagccacagcccagtctcatgccctgtgaaggggataagggaacttttcccgtttcaatatcattcacattagcaataacaactaaaatatgcagaaattattttcaaaagaaatacacaagatctctattgggaaaaacattaaaatctagtaaaggacatggaagaaaatataaataaattctagacctttcctcttttcaaatggatttcgttaatattatacagatgttaattctcctctaattaatctataaattaaagtttagttgggtttttagcttaatatgcacaaatagctaagttaaccttaaaaaaaaaaagacaaaagaagggagattttctctaccaggcagcacacatattacaaagtcagtggagtgaaaacagtcggatattggtcctcaaacagaaggctagtcaaacagaatagatagctgaagttcaaactcacatattaatttaatataaaataaaaatcgcactccaaattaatggggagtggaaaaattcataggtgattataggaataatgaatctctatatagagaaatataaagctggattcctacgtaacatcacaaacaatgctgaattccaggcggatgaagggcctagaagtgaaaggcaaaactcaaaggttgtttctgtcctgtgtatatacccttttctgataaatatatggaacaaactaggaattcaagggaacttcttcaacctgattgatggcagctgtaaccaaaactagaagttaacatcacacataagggaaagactaaaatcttttcctctatggtaaagaacaaaataaggatgtctacgttcttcactttgattcaacattgcactggaggttctagttagcataattagccaaaattggaaagaagtaaatctatctctatttgcagatgacttcatgttgtatatagaaaatcctaaggaacacacacacacaaacacatacacacacacacagaactaatgaaggagttcaacaacattgtgtaggatacaagatcagtatataaaaataaattttatttctatctactttggaataaaattgtatgtctattgacattaataatgtgaacattaagaaaacaatctgatttaatcaaaatgattaaaatacttaggtataaatttaacaaaagatgtgcaagacttatatgctgaaaactacaaaacatcattgaaagaaattaaagaagccctaaatcaatagaaagacaagctgtgttcatgaattgaaagccttaatattgttaagatggcattactcatcaagttgatctacagattcaatgcaagccctatcagaattccagctggccatttcacacaaattggtaagatgatcctaatatccacatagaaatggaaaggaccagaatagaaaaaaatgtcaaaggcaaatttttaaatttcaaaacttactacaggccgggcgttgtggctcacgcctgtaattccaacactttgggaggctgaggtgggtggattacctgaggtcaggagttcgagaccagcctggtcaacatggtgaaaccccgtgtctactaaaaatacaaaattagctgggtgtagtggcacatgcctgtaatctcagttacttgggagggtgaggcaggagaatctcttgaacccagcaggtggaggttgctgtgagccgagatcgcactgctgcactccagcctgggcaacaagagtgaaactccatctcaaaacaaaacaaaagaaaacttactacaaagccacagtaatcaagatagtgtggtgctgacataaagatagacatatagatcaatagaataaagagtccagaaacaaacatttatggttcactaataatttacaaggatattaaaagcaatcagttgggaaagaatactcttttgaataaatggtgctgggactaccggatatttacttgcaaaagaataaaggaaacatagtacatccatacagccaaataatattcagtcataaaaaggagtggagtaccgatacatgctacaatatggatgacccttggaaacattatgtaagtttaagaagccagtcaccaaaggccataatgcagattccagttaatatgaaagatgtagaataggaaaatccatagagatgaatgtagactgtggctttttgaaggtgggtggaagggggaatggaaaatgattactaatgtgattaagatttctttttggggtgatgaaaatattttggaattagataacagcagtggttgcacagctttgtgaatatgctaaaaaccactgaattgtacactttaaaaggatgagttttatgatatgagaattatatttcagtttttaatttaaaaattgaatttgaaggagaaagtattccacagaatcttatcggtccttggtgaaggcagtaaggttttctggcccatgcttttctcaaataattggtactttaaattgattcaacagctggaggaacagtttgtccttcctatgttttgtgtgaaaatgtctacctcctgtgttttggtatctgagttagggttgggctatggaacttctcgagttgtattcctaagacgtcttgattatttataagccccatgaatgttattccacccatgataatctgggctacatggactgtgatcttggatgttagttcagcttatttgaaccttaatttcctttacaatatctgcttctcagtgttgtaaagtctaaatgagataatagactttaagtgtctatcatagtgcctggcctgatgtaggccttggttaatgaatgttagcttcctccctacacgtttcccttcattaaaaaaaaatagtaaaaagcacatttctttctttcttccctgtccaccccgcctgaaacagagtcttgctctctcacctaggctggaatgcagtggcacaatctcggctcactgtaacctccacctcccaggttcaagcaattctcctgcctcagcctcccaagtagctgggattacaggcgtgcaccaccaagcccagctaattttttttctcttttttttttttttgtatttttagtagagatggggtttcaccatgttggctaggctggtctcgaactcctgacctcaggtgatccgcccgcctcggcctcccaaagtgctggcattacaggcatgagccactgtgcccggccaaaagcacatttcttatatgtcacaggtcactcagctctgccctagcttcctgcccagcaacagattgcttgtagcaataaaccatgggtgatttttttttctttgatccgtgtgtcccctgctgtgcctcttctactacctggcacattgcaggtgctcagtgattttggatttcgcatgagacagcacaagccatttacattgattttccagcatgatgctaagagaatagtagagtgtcagcattagtctgtgacaaaggaacattgttagtgctactttagatgctgtgtttcttccagttgtgctgagtagcagagaacttaattaaatttcatactcgagaagagtaaaggctgagtccttcatctgccacaaatctttacaacccttgctttctagttaaactttccaggattttttttctctgtttttaatatcagctttttggagtgaagtgcttaaataataccaagtaatttattaaaaagagacaatcccaggttcctatttctttggaaatgttttacttattattagctgtctaagtgcattgtagattaaccttttcatgacaaatatttacttccatttgtgttatgtcttcttcctttgtaagaaaatttgaatgagtggttaatctatgtgaaaaatattggagggaagaaaatatatctactgcacaggcccttttaaggtatcattctctaaggagcagcttccatagctttcagctgtaaaaatagggactgccatttctgcaggcagaatggtttggggttatatttcaggaagctgaaactgctgagaccaatacaaagttaattctccgttgcttttttttccttccaggagctagagggattgaccacctgaaacctgacactatctccttcattctcctttctaagcagacagagttacaactacagacatttaatctttgcccttctttcccacctttaggagcggaaaaagaaatttgaaaaggatggtgagaggttttattctttactggatcggcacttacacctgtcttcaaaaaagaaagaatctcagttacaagaggtatgttcacaaagcctgcccctgccttccattgctagctatgccttagaaacagtgtgaattttgtactgcaaggcttttcccataccccgtctcagcagggaacctcatgtgatagtagcacttgtagtcaaaactgtggcctgagactcagaagccctgaatactaagccagctcttccactaactcagggtgtgaccttggataggatacttctttctttgcctcattccattatctgtaagaagaggagtcgagagtccctttcaattgcaagtccaaaatccatgcgaggataaagttaaactagtgttgtatttggtagaaatcaggaacagatcttctacttttttccctgagagattccacaacctttttttttttttttttttttggtgaggggttaggggaatgttctgttttgggactactgcttacctgggacttgcagtgccttcagttcaaataagctaccattcggtgagaccctaccacatgccatgaactgtactggatgcaacatggctacagaaacaatgagacatgattcctgcccttctgcagcttactgttgggctactaaataagaaaacacattactcttatacaaatagattttttttacatactttaatgtgtatatggtgcttttgttgggagtgggaaatgagaatagaagacttatgtttggatgtggggaatttcctttgtggaagaatgttgcccttccaatttgacgtggtcattaaaatataggtaaagtgtttgacaggtgaaaatggataaatggacctttcaaacagagaccaatggcccaaggatggaaggaacataagtagaattctattttaggaatctcaaactggcataggttgtagggtgaattagatcagggagagactagaagcaggataaacagtttaggaaactattgatctaggaaacgatctaggggaaagtgacagagccgtaagagaggcactagggaaggaaaagaaggaataaactgattgagaatttttctaatggaaggaggggtctatatgttcaatgaaagattcagtaataatggagattttaaagattcaagtatgaaaagagatatctgatggaataatatcataggcaggagctgtcatcttgtccatggtcacacagattgtggcagagctggagctcatctcctgataactggtttcatagatatccatcacatcatctgaggtgcttgaaggtaataggtcaagagcctcagtgtggccgagtgcagtggctcatgcctgtaatcccagcattttgggcggccaaggcaggtggatctcttgaggtcaagagtttgcaaccagcctggccaacatggcaaaaccccagctctactaaaaatacaaaattaaccgggcatagtggcacatgtctgtaatctcaattacttaggagactgaggaagaagaatcgcttgaacccgggaggcggaggttgcagtgagctgagatcactccattgcactccagcctgggtgacaagaacgaaactctgtctcaaaaaaaaaaaaaaaagccttagttgtggatggagttagtattgcaaaggagaaggactactttccttccataaactagaattgagtctgggatcttctatcattttccttttgcccacttttgtttttttccttttctatctattctgtgtcgcggtttctatgcagaaaacagtcaacaggcctgagactgctatgcttagaaagacctgtttacaaaattagcccttggaatggcatctgggaacttcactgttaaacagctcccaacattgatttagaagtttcccttaatgggtaagaatggctgactgtgccaagcctggctctgcaaataatgtagcttatgtcgaacacctttttcttctggtactcttgaattttggttgtgctgggcagagtgtgcctgtgtaactagccccgcagtaaaaccctaagctactcattctcttatgagcttccctgactgataacattttctctgtgttgttacaacttgttgaaggaagaattaaatgtgtcttgggtgacaccaccgtgagagatcttttggaagcttttacctagcttcctctgcattttgccccaggcaccttttctctttgctcagtcggctgtgtacgctttcactgaaataaatcttagctgtgagtactactatgttgagtactttgagtcctgctcaaaaaagatttattaaagaattattaaaattggggtggtcttctggaccctggacacaatccaaactattggagacttttgctaggacaccttctggagtgttctaggtgtttggtgctatatctagatgtccttttattacttattcaataaaaaaatgagcagggcaatcttgagttagtcactttcaaaaaatttagatttcatctttagagaagttttaggtttacagaaaattaaatagtaagtacagagttctcatatgcccttactccctcacacagtttctcatttcctcttttaggatcatcttgcatttgtgtgatacatttgttagaattgaggagccaatgtattaaacattctatgggttttgaaaaacatatgataacatatatccagcattaccatattgtacaggacagtttcgctgccttgaacatccctggactttatccctccctccttctacctctacctctgacaccactgatctttttatggactccatacttttgccttttccaaaatgtcatatagttggtatcatatggtttgtaaccttttttgattggcttcttgtagttagcaagatgcatttaaggtttctccatatcttttcttgacttgataactcacttctttttagggctgaataatatgccattgtctggttgtaccacggttggtttatccatttgcctattgaaggacttcttggtttcttctgaattttggcagttattaaagctgcgataaaaaattgtgtgcaggcttttagggatatacattttgatgttgtttgagtcaataccaaataatacaactgctatcatatggtaagattttatctagtgtcgtaagaaactgccaaactgtcttccaaattgactgtagcagtttttatttccatgaacaatgaatgatagctccggttgctccacatccttgtcactattctgcgttgtaccattaaaagtaatggcagaaatcacagttccttttgcaccaacctaatatgtacatggaatatctttccatttattttgacctttgatttttttcatcagtgttttgtagttctcctcttaaatatcttgtctttttgtgcctggcttatttgacttaacaaaataactttcagttccatccatgttgttgcaaatgacgggatctcatttttttcattcttttatttctgatgccacttctttgtgtatttactctcttacttatttaatgtggctaaaatattaacaattttattgatttttttcaaagaaccagctttttggttttgttgatttcctgttgttaatttcgttgatatcttcatcttcttttttttattatactttaaattataaggtacatgtgcacaacgtgcaggtttgttacatatgtagacatgtgccatgttggtgtgctgcacccattaactcatcatttacattaggtctatctcctaatgctatcccacccccctccccccaccccacgtcaagctccagtgtgtgatgttccccaccctgtatccaagtattctcattgttcaattcccacctatgagtgaaaacatgtagtatttggttttctgtccttgcgatagtttgctcagaatgatggtttccagcttcatccatgtccctacaaaggacatgaactcatcattttttatagctgcatagtattccatggtgtatgtatgccacattttcttaatccagtctatcattgatggatatttgggttggttccaaatctctgctattgtgaatagtgccacaataagcatatgtgtgcatgtgtctttatagcagcatgatttataatcctttggatatatacccagtaatgggatggctgggtcaaatagtatttctagttctagatccttgaggaatcaccacactgccttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgattttttcttgtaaatttgtttaagttctttgtagattctggatattcgccctttgtcagatgggtagattgtaaaaattttctctcattctgtaggttgcctgtgcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccttcttgaattaatttttgtataaggtgtaaggaagggatccagtttcagctttctacatatggctagccagttttcccagcaccatttattaaaaagggaatcgtttccccattgcttgtttttgtcaggtttctcaaagatcagatggttgtagatgtgtagtattatttctgagggatctattctgttccattggtctatatatctgttttggtaccagtaccatgctgttttggttactgtagccttgtagtatagtttgaaatcaggtagcatgatgcctccagctttgctcttttggcttaggattgtcttggcaatgtgggctcttttttggttccatatgaactttaaagtagttttttccaactctgtgaagaaagtcattggtagcttgatggagatggcattgaatctataaattaccttgagcagtatggccattttcacgatattgattcttcctatccatgtgcatggaatgtacttccatttctttgtgtcctcttttattttgttgagcagtggtttgtagttctccttgaagaggtccttcacatcccttgtaagttggattgctaggtattttcttctctttgaagccattgtgaatgggagttcactcatgatttggctctctgtttgtctgttattggtgtataggaatgcttgtgacttttgcacattgattttgtatcctgagactttgctgaagttgcttatcagtttaaggagatttggggctgagatgatggggttttctaaatattcaatcatgtcatctgcaaacagggacaatttgacttcctcatttcctaattgaataccctttatttctttctcctgcttgattgccctggccagaacttccaacactatgttgaataggagtggtgagagagggcatccctgtcttgtgccagttttcaaagggaatgcttccagtttttgcccattcagtgagatattggctgtgggtttgccataaatagctcttattattttgagatacatcctatcaatacctagtttgtttagagtttttagcatgaatggctgttgaattttgtcataggccttttctgcatctattgagataatcatgtggtttttgtctttggttctgtttatatgctggattacatttattgatttgtgtatgttgaacgagccttgcagcccagggatgaagccaacttgatcgtggtggataagctttttgatgtgctgctggattcagtttgccagtattttattgaggatttttacattgatgttcatcagggatattggtctaaaattctcttttttttttgttgtgtctctgccaggctttggtatcaggatgatgctggcttcataaaatgagttagggaggattccctctttttctatggattggaatagtttcagaaggaatggtaccagctcctccttgtacctctggtagaatttggctgtgaatccatctggtcctggactttttttggttggtaggctattaattattgcctcaatttcagagcctgttattagtctattcagggattcaacttcttcctggtttagtcttgggagggttcatgtgtccaggaatttatcatttcttctagattttctagtttatttgtgtagaggtgtttatggtattctctgatggtagcttatatttctgtgtgaaaggtggtgatatcccctttatcattttttattgcaactatttgattcttctctcttttcttctttattagtcttgctagcagtctatcaattctgctgatcttttcaaaaaaccatctcctggattcattgattttttgaaggtttttttttgtgtctcttatctccttcagttctgctctgatcttagttatttcttcccttctgctagcttttgaatgtgtttgctcttgcttctctagttcttttaattgtgatgttagggtgtcaattttagatctttcctgctttctcttgtgggcatttagtgctataaatttccctctacacactgctctaactgtgtcccagagattctggtatgttttgtcttgttctcgttggtttcaaagaacatctttatttttgccttcatttcgttatatacccagtagtcattcaggagcagattgttcagtttccatgtagttgagcggttttgagtgagtttcttaatcctgagttctagtttgattgcactgtggtctgagagacagtttgttataatttctgttcttttacatgtgctgaggactgctttacttccaactatatggtcaatttttaataagtgcgatgtggtgctgagaacaatgtatattctgttgatttggggtggagagttctgtagatgtctattaggtccgcttggtgcagagctgagttcagttcctggatctccttgttaactttctgtctcgttgatctgtttaatgttgacagtggggtgtcaaagtctcccgttattattttgtgggagtctaggtctctttctcggtctctaaggacttgctttatgaatctgtgtgctcctgtattgggtgcatatatatttaggatagttagctcttcttgttgaattgattcctttaccattatgtaatggccttctttgtctcttttgatctttgttggtttaaaatctgttttatcagagcctaggattgcaacccatgcctttttttgttttccatttgcttggtagatcttcctccatccctttattttgagcctgtgtgtgtctctgcacgtgagatgggtctcctgaatacagcacactgatgggtctcctgaatacagcacaatgatgggacttgactctttatccaactttccagtctgtgtcttttaattggagcatttagcccatttacatttaaggttaatattgttatgtgtgaatttgatcctgtgattatgatgttcgctggttattttgctcgttagttgatgcagtttcttcctagccttgatggtctttacaatttggcatgtctttgcagtggctggtactggttgttcctttccatgtttagtgcttcctttaggagctcttgtaaggcaggactggtagtgacagaatctctcagcatttgcttgtctgtaaagtattttatttcgcctttacttatgaagcttagtttggctagttatgaaattctgggttgaaaattcttttcattaagaaagttgaatattggcccctactctcttctggcttgtagagtttctgccgagaaatcagctgttagtctgatgggcttccctttgtgggtaacctgacctttctctctggctgcccttaacattttttccttcatttcaactttggtgaatctgacaattatgtgtcttggagttgctcttctcaagcagtatctttgtggcattctctgtatttcctgaatgtgaatgttggcctgccttgctagattggggaagttctcctggataatatcctgcagagtgttttccaacttggttccattctcgccgtcactttcaggtacacaaatcaggcgtagatttggtcttttcccatagtcccatatttcttggaggctttgctcgtttctttttattcttttttctctaaacttctcttctcacttcatttcattcatttcatcttccatcactgataccgtttcttccatttgatcgaatcggctactgaagcttgtgcatgtgtcatgtagttctcatgccttggttttcagctgcatcaggtcatttaaggtcttctctatgctgtttattctagttagccattcgtcttatcttttttcaaggtttttagcttctttgcgttgggtttgagcatcctcctttagcttggagaagtttgttattaccgatcatctgaagccttcttctctcaactcatcaaagtcattctccatgcagctttcttccattgctggtgaggagctacgttcctttggaggagaagaggtgctctgatttttagaattttcagcttttctgctctggtttctccccatctttgtggttttatctacctttggtctttgatgatggtgacgcacagatggggttttggtgtggatgtcctttctgtttgttagttttccttctaacagtcaggaccatcagctgcaggtctgttggagtttgctagaggtccactgcagatcctgtttgcctgggtatcaccagcagagtctgcagaacagcaaatattgcagaatggcaaatgttgctgcccgatccgtcctctggaagcttcatctcagaggggcacccagctgtatgagttgtcagttggcccctactgggaggtttctcccagttaggctactcaggggtcagggacccacttaaggaggcagtctgtccgttctcagatctcaaactccgtgctgggagaaccactactctcttgaaagctgtgagacagggacatttaagtctgcagaggtttctgctgccttttgttcagctatgccctgcccccagaggtggagtctacagaggcaggcaggtctccttgagctgtggtgggctccacccaattcgagcttcccagctgctttgtttacctactcaagcctcagtaatggcggacgaccctcccccagcctcgctgctgccttgcagttcgctctcagactgctgtgcttgcagtaagagaggctccgtgagcttgggaccctctgcaccatgcatggtatataatctcctggtgtgccatttgctaagaccgttggaaaagcgcagtattagggtgggagtgtcccgattttccaggtactgtctgtcacagcttcccttggccaggaaagggaattccgcaaccccttgcgcttccagggtgaggcgatgccctgccctgcttcggctgacactctgtgggctgcacccactgtccaacaagccgcagtgagatgaactcagtagctcagttagaaatgcagaaatcacccatcttctgtgtcgctcacactgggagctgtagactggagctgttcctattcagccatcttggaaccttcagtcgatatcttctttaatgtttattttttcttattttctgcttactttggatgtgatttattcttctatttctagtttcctaagaaggaagcttacattattaataagagatctttcttctattctattatatgcatttcattctataaatatttctctaagcactgcttttgttgcccacaaatattaaattgtgttttcatttttatttaattcaaaatgtcttaacatttcttattttattttatttattttttgtagaattgaggtcttaccatgttgcccaggcgagtttcaaactccaggtttcaagtgatcttcccgccttgccctcctaaattgctgagattacaggtgtttgccatgatgcccagccttacttttctttgcgtctttgactcaggtttcatttataaatgtactgtttaatctccaattatttggggcattttcagcttttaaaaattgatttctggtataatttaattgtggtctaattgtatatttcataagatttctattcttttagatttcttcaggtgtattttatgtcccagaatgtggtctatcttggtgatttttctgtgtgactttgagatgaaagtgtattctgctgttgtatcaagtgttacaaagatgtcagttagattcagttgatcaatggtgctgttcaggtcaacaatgtccatacggattttctgctagctggatctgtccattactattagaggagtattgaagtctccaactctaatagtaggtgtgtctctccttgtaattctctcaatttttacctcatgtattttgatgctgtgttgttaggcacattcacattaagaattgttatgtcttcttagagtcttgccatctttattattatattatgatttgatatcataatatttttccttggtagttttctttgttctgaagtatgctttttatgaaattaatatagctactctagcattcttttgattaatgttagcatgatatatctttctttatacctttacttttaatctgtctttgttttctttacattttaattgttatttcaataggtttaggggtataagtgttttttggttacatggatgaattgtatagtggtgaagtctgggcttttagtgtacctgtcacccgaatagtgtacattataccgaacaatgggtaatttttcagccccctctcaccaccctttttctgagtctccaatgtccattataccactctgcatgtctctgcatactcagagcttagctcccactaataaatgggaatgtgaggtatttgatttgagttagttcacttggaataatggcctccagttccagtttctgtaaaagacattattttgttctgtttcatggctgagtagtattccattgtgtgtgagtgtgtgtgtgcacacatatatacctactatattttctttatccactaatcagttgatgggcacttagattgatttcctgtctttgcaattgtgaattgtgtgaagataaacataggagtgcaggtgtcttttctgatgtaatgacttcttttcctttaggtagattctcagtagtgagatcttggatcaaatagtagttctacttttagttatttgagagatctctatactgttttccatagagactgtatgaatttacattcctacccaaagtgaataagcattcccttttaaccacatctgcatcttttgttttttgactttttaataatggcctttctgagtggagtaaggtggtatctcattgtggttttaatttccattttctttttttttctttttatttatttttatttattttttctattatactttaagttttagggtacatgtgcacattgtgcaggttagttacatatgtatacatgtgccatggctggcgctgcacccactaactcatcatctagcattaggtatatctgccgatgctatccctcccccctccccccaccccacaacagtccccagagtgtgatactcctcttcctgtgtccatgtgatctcattgttcaattcccacctatgagtgagaatatgaggtgtttgcttttttgttcttgcgatagtttactgagaatgatgatttccaatttcatccatgtccctacaaaggacatgaactcacattttttatggctgcatactattccatagtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcccctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgaggagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgtttgctctgatggtagtttcttttgctgtgcagaagctctttagtttaattagatcccatttgtcaattttgtcttttgttgccattgcttttggtgttttagacatgaagtccttgcccatgcctatgtcctgaatggtaatacctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatcgttccccatttcttgtttttgtcaggtttgtcaaagatcagatagttgtaggtatgcggcattatttctgagggctctgttctgttccattggtctatctctctgttttggtaccagtaccatgctgttttggttactgtagctttgtagtatagtttgaagtcaggtagcgtgatgcctccagctttgttcttttggcttaggattgacttggcgatgcgggctcttttttggttccatatgaactttaaagtagttttttccaattctgtgaagaaagtcattgggagattgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgaaacagtggggttttctagatatacaatcatgtcgtctgcaaacagggacaatttaacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcctctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgccaggctttggtatcagaatgatgctggcctcatgaaatgagttagggaggattccctctttttctattgattggaatagtttcagaaggaatagtaccagttcctccttgtacctctggtagaattcggctgtgaatccatctggtcctggactctttttggttgctaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttacttttctatttcttttaattgtgatgttagggtgacaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttatgtacccagtagtcattcaggagcaagttgttcagtttccatgtagttgagtggttttgagtgagattcgtaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtacagagctgagttcaattcctgagtatccttgttgactttctgtctctttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccgttatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgagaattcttttctttaagaatgttgaatattggcccccactctcttctggcttgtagggtttctgccgaaagatccgctgttagtctgatgggcttccctttgagggtaacccgacctttctctctggttgcccttaacattttttccttcatttcaactttggtgaatctgacaattatgtgtcttggagtcgctcttttcaaggagtatctttgtggcgttctctgtatttcctgaatctgaacgttggcctgccttgctagattggggaatttctcttggataatatcctgcagagtgttttccaacttggttccattctccccatccctttcaggtacaccaatcagacatagatttggtcttttcccatagtcccatatttcttggaggctttgctcatttctttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcatctgaagccttcttctctcagctcgtcaaagtcattctccatccagctttgttccgttgctggtgaggaactgtgttcctttggaggaggagaggcgctctgctttttagagtttccggtttttctgttctgttttttccccatctttgtggttttatctacttttggtgtttgatgatggtgatgtacagatgggtttttggtgtggatgtcctttctgtttgttagttttccttctaacagagaggaccctcagctgcaggtctgttggagtaccctgccgtgtgaggtgtcagtatgtccctgctggggggtgcctcccagttaggctgcttgggggtcaggggtcagggacccacttgaggaggcagtctgcccgttctcagatctccagctgcatgctgggagaaccactgccctcttcaaagctgtcagacagggacatttaagtctgcagaggttactgctgtctttttgtttgtctgtgccctgcccccagagatgaagcctacagaggcaggcaggcctccttgagctgtggtgggctccacccagttcgagcttcctggctgctttgtttacctatgcaagcctgggcaatggcgggcgcccctcccccagcctcgctgccgccttgcagtttgatctcagactgctgtgctagcaatcagcgagactgcgtgggcgtaggatcctccgagccaggtgcgggatataatctcgtggtgctccgttttttaagcccgtcggaaaagcgcagtattcgggtgggagtgacccgattttccaggtgccatccgtcacccctttctttgactcagaaagggaactcgctgaccccttgcgcttcccaagtgaggcaatgtctcgccctgcttcggctcgcgcacggtgcgcgcacccactgacctccgcccaatgtctggcactccctagtgagatgaacccggtatgtcagatggaaatgcagaagtcacccgtcttctgcgtcgctcacgctgggagctgtagaccggagctgttcctattcggccatcttggctcctccccaatttctattttcttgatgattagtgatgttgagcattttttcatgttattggccatttgtgcatcttcttttgaaaaatgtctgttcatgtcgtttgcccacttttaaatgggatttttttttcttgctgatttgttggagttccttgtagattctggacactagccctttgtcagctgtacagtttgtgaatattttctcccattctgtaagttgcctatttactctgttgattatttatcttgttgtgcagaaagattttagtttaattaagtctcatttatttatttttgtttctgttgcatttgctttaggtgtcttagtaatttttttttattaggccaattcctagaagcatttttctgtgttttagtctagaagttttatggtttcaggtctaacatttttgtgtatcttatttaaaatgatatcttttaggtaacatagttggctcttaatttttgtgcactatgacagtctatcttttaatttttttagatcactgacgtttaaaagggtcatagataatggtgtaatagtatctactatattgtttaccatcttctacttattgtttttgtttttatttttgtctttcagtcttcttttgacttctcttttttaagagaatattttatatgatcttattttctgtcttctcttaccatgtaaattatacttcttctttttcattttttaatggttgccttagagcttgcaatatgcatttgtggttagtttatgtccacttttcaaattccagtaacgtagttatgggttgtacaggatcaacagactatttccaatttctccatttagtcccttataatggtactatcattctttttacttatttgtaagatacaatcaccaaatgtatcattacaattattattatagacaaattcttatctgttaggtccattaagaatttgaaaaataaaatatttaatcttcatttatttcttttctagtgctctttttttctttctttttaggtctatatttccgacatatcatttttcttctactggagatcttttgtcctttcttgcaagacaagtttagtggtgacaaagtgctttaatttttgtttgtttgaggaagtctttattttaccatcacttttgaaggataatttcacagtttacacattgttaagtagttaactttttttctttcaacaccttcaaatattttatagcactcttttctttctgcatggtttcttaagagaagtctgatataactctttatccttgccctgctgtatagtaagttgtttgtttttctctctagcttctttcaagattttctcttgtattttattttctgcagctttgaatatcatatacctacatggggattgtttggtatttatcctgattggtatttattagtatttattatattattgtatttattggtatttatcctgagctttctggatgtgggtttgatacctgtcttttattttggaaaattctcagtcattattgcttgaagtatttcttctgtttctgtctctttttcttctcctattggtactctgaaaatacgtatattaacatcttttgtaattgttcaccagttcctgaatattctactccatgtttgtcattctttttttctctttgcatttcagtttcccacattttttttgacatgtatttaagcttactggttctttcctcactcttgttcaatctactggtgaaccctttaaaagtagtcttcatttctgctacagtgtttttgatttctagtgttttctctgtatactctcttgcagttttcatctgcctgctactattacccatctgttcttaggtgctgtctgttttttatattagagcccttatcatattaattataattattttaaatttagttttatgtttcttttttgtttgtttctgagatggagtctcgctctgtcacccaggctggagtgcagtggcacgatctcggctcactgcagtcttcacctcccaggttcaagtgagcctcgtgcctcagcttctggagtagctgggactacaggagtacagcaccacacttggctagtttttgtatttttagtagagatagggtttctccatgttggccaagctggtcttgaactcctgacctcaggtgatctacccacctcggcctcccaaagtgctgggattacaggtgtgagctaccgcacttggcctacagtcttatatttctacaatgtctgccttacctacatttgattctgatgctccttttttctcttcagactgtgtttattgccttttaatatgccttgtagttcattgttgaaagctagcggtgatgttcagatgaaaggaactgagtgaaacaggtctttaatgtgaggttttgtgttgaactggctaggagctaggctgtgcttagtttgctgtagctgtcattgtctgactctaaaattttctctggcatcattgtttatgtgctcagattttaccatttcttgttaaataagacttgagacttgcagttctttctgttgtaatcccctcagtattggccatagtagcatgcttctgttcttgggctttggcccttgttaatttcttattctctgtattcatgtctctgtagtgtttgagggagcagattttcctctgacttcagttctctgttgaatataataaaatgtgtggattttacacttgttcagcttttttctttttgtcagggtggatgtaatgacttcaagctttttatgtgttggaccagaaactggaatcctgtatcagtcacttttttatctcttggctttaggttctctatttctaaaataaaaggtaacatcactagttggtggctaaatgctcatctagctctagcattctgttcaatccttaagtactgactttcatgaatgaatatcccaatatgtaatgtttgttttccttcttctacaggcagacctacaggtggacaaggagaggcacaattttttcgagtcctctcttgattatgtttatcaaatccaggaagttcaggagtccaagaagttcaatattgtggagcctgtaagttttctctgttgatgaatggtctaaaaatatttatcaaatgcctggtaaatgtacaaactttgatcataaaaacagaatcccaaagaacgtgaaggataatcagtggaaatgtctagaacgtagtctaacttacgtttttcttgttctttagtatactttttttctctctttccccccaacccttttctctctttttctatggctattttctttctctttcctttttttcctttctctttcctccccccttccggaatttctctacaactcttcctgttactttgtttccctcccttccttcttcttgcgctttcagaagcttctgaaagtctttctcatataccagatactatgctagggactcatgtctcttgcagtcagtgacttctcattctactacttttacttctgtcttgtgtagttttttcccatttcacgttttttcattccatttacttcgttttgtgtagatttttccatttccatatatttgtttgagacagggtctcactgtcacccaaactggagtgcagtggtgctatctacaacctctgtctcctgggctcaagtgatcctcccacctcagcctcctgagtaactgggactacaggtgcatgcctccataccgagctaatattttgtatgtttttgtagagataaggtttcaccatgttgcccaggctggtctccaactcccgggcccaagtgatccccctgccttggcttcccaaagtgccaggattacaggcatgagctaccatacccagcccgtgtatttgatttttaatggggttgaaaatttacaccaatatatgttgtgtatcatttatatgtctttttctgcaaccctgtgaaacatttctaattttaaagttggtttagactcctttgatcttttagcattatgacagtcttcattaaagttaggtagaaaatcttgctttattcatttatctatttactttcattcattcaagaaatatttattgagcacctattgtttgtggttgctgaggatatatagaggaaagatgcagttcatttacatactgttcaaatgatgaatgtctttatatgagatctgaacaagctcagggttaataaatttgttaatagttctttttttctgaagctgagtcaagggtaaatgttcaacctgatatgaaaacagtgatgtgtagactggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtcatgctggttcttacagatgggcatgtaggcatagtgttcccatccttttcacatatattcctttacatgttcctttattcaacccacattaaacaaatgtttatggaaaaaatgaacataagctctgtgccaggcatgtgaaaggcactggacatgccatgaagatgcatgcaagtttttctgtcttgaaggaacatacagtttcttgtaggagacaaataaacagagataaattataatccattatgataagtgctataatagaatcaaggccaaaggtttttaaaaagttcagagcatttggctacctggtagagtcagagaaggcattactgagttggtgactttagaatgggtgttaaattgcatgaaatatatagatgtagttttagatgaaaaatgctggtaagttatagtgaaaaataagccccccttggttgtttaggaggattgggatttacagttgttgttattattttttctttctatatactctccttgcagaaaggaactaggggctctcacattctccagaatttcctgatttacaacatcttcctactacaaccaagttaatcccatgaatcttcctctatatattacttgatatgtacaaatgtaacaataagcctttgaatgtgtacatatgggtgacttatttacaggataaacatgagccaactagatgggcagcacagatcacctttctcactaacatcatgtcataattttaagactgggtactaaaaacttatctgtagtgattttcatacccacatttcaacacatgtcttaccattgtgttttagttgtgtagatttaaatagatttattctcatcattaggttttggtatttgtgagtatgaaaacatagctactgttggcccttctcccaagagagcaccctctcgtatattttatgttcttggccagaatttgattcagtatcaactaggctgtaactttgagacacaatttggaagttgctatgagaatgctacctttgggaaccttgtctgccatctcccttgttgtaaagcagggtatcagtcatgttcagaattctaagattgcttatttattagggccttatgtgattcgtattagtaaaaagcctcccagttgttattttatgagtatattgctcgttatatttttgtttcctatgcagtctttaggaccgttagactctataaacttgttttccattcactatgccattcaccatttctttttttgctttgtggttgcacatgctgtaagcagggaaaactttgtactgagtctctgaccaagaaatactttttcatgataatgatgatgataataatgattttcatgatgatgtcttgacagacaagaaatcatttctccagtacccgggaagagatggaagaacttaagaaaaggatgaaagaagctccccagacatgcaaacttccaggacagccaactattgaaggctatctctatacacaagagaaatgtgtgtggggacataggggtatccattgggtttcaataagccaggaactactgccacttgtcggctgtgaattttgggcacccttactgttcatagacccctgatagctaaaattcccttggaacgcaggcagggaatactgaaaacaaaaaaaaaaaaaggagaaactgagaggaagttaaagatttgtcttacaaaggctgtgtagtgataagacctaaggttttctctgagattcaaaatgggtattatttgttctttaatccttctgattattcttttggaaaaaagggaagtagaggaaaggaagtagaaaaataatatttcttatacttattatgtaccagacatggtgctaagttcatttaaaacactgcctcatttaatctttgcaaccaatttatacccatacacataaggccactaaggctcagagacgtcaccatttgaaagtcacccaactaacaagtgtcaggactaaaattaaattcaggtctatgaaatgccaaagcccatgatcctactatagtaccctatatcttcgtctgcattagggtcatatgtttgctcttttcttttctttttttaagacaggatcttgctctgttgtccaggttggagtgcaatggcaccatcatagctcactacagcctcatactcctgggctcaagcagccctcctacctcagcctcctgagtggctgcacctaaaggcacctaccactacacttggctaagttttgaattttttgtagagacaaggtctcactatgttgctcaggctcatggatgctcttatagcacttagtgaacatcatgattccagtgggaaagacagtatctgtttttcattggtgactaagtaaagtgggttaacttgtttagtcactgaatgttgcagagcattcaatctttcctaattcctcagtaacattatgcacacctgtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgatctcagtgctgttgacatttcaggctggataatttttagttctgggaagtggtcctgtgtattatagtatatttagaagcatccctggcctcctcactttgtgctcatagtaatctccaggtgtgacaacctaaaatgtctctaatgtattgccacatgtcccctgggaggccaaattacccctagttgagaaccactgctgtatgctgtgtgatccttctgtgcttcagtattctgatttgtcatatgggcataacattgctactcagttgaatgtatgcttaatgagcactgtttctgccagatactgtgcaatgcattggggacacccttgaaaaactgaatcaaccatgatttctttcaccaagaagtgtaaagtgatgggagagatagacaagtatatcaataattataatgaaatgtggtgataactgtatttggggcatatatctaaaggcttcacaaagaaagtgatatttgaactagaacttgaatgatgagtgggagtttgataggtaaagaaaaggaggaatggccgggcacagtggctcatgcctgtaatcccagcactttgggaggctgagacggcagatcactggaggtcaggagtttgagaccagcctggccaacatggtgaaaccccgtctctactaaaaatacaaaaattagctggatgtggtgatgcttgcctgtaatcctagctacttgggaggctgaggcaggggaatgacttgaacctgggaggtggagattttactcagccgagatggtgccattacactccagcctgggtgacagagtgagactctgtctcaaaaatgaataaaagaaagaaagaaagaatgaaagaaagaaaagaaaagaaagaaaggaaagaaaaaggaaagaaagaaaggaaagaaaggaaagaaagaaagagagagaaagaaagaaggaaaaggaggaagggaattccaggtatataccactgcatgagtaaaggcagggttgtggatagacatagttgatttgtagggcccttgtttgccaagaatagtcctgctttacccctgttgtcctgatgtaattattaataatactgcctcattcagtcttaaataagtcttggatttggactagaaattatatggctacctctttatgtgggaactaaaagtaattcattgagacaggaacatagaggtgaggtgccaaaagaaaaagctagaaaggtaagttttgatcatgttatcaagggcattgtaggcaggctaaggagtgtggagatagtgggaaagccgtggatggtttttaatgaggggaatgataaaaatagagatatattttaaaaataatctaggaaaagagtggagaatgaattggagtggagtgatcagagatggggacaatagggaaatcagagaaggccaatgaaataattaattggtgagatagtaaatttttgttttttaaaaatatgtttcataaaatataaatacaaaataagacactgggcccagcgctgtggctcatgcctgtaatcccagcactttgggaggctgaggcatgcagatcacgaggtcaggagatcaagaccatcctggctaacatggtgaaaccccatctctactaaaaaaaatacaaaaagttagccgggcgtggtggtgggtgcctgtagtcccagctacttgggaggctgaggcaggagaatggtgtgaactggggaggtggagcttgcagtgagctgagattgcgccactgcactccagcctgggtgacagaacgagactctgtcaaaaaaaaaaaaaaaattaaaacaaaaacaacactgatagggttcttaactaattcggtgttaaaaaggaatggagaggaggagacagttaaaagagagatgtgtagagtcatgtacaggttagaaggggcataacccaatgaccaatgacatggaacagttatagagacagcaaagtaaatgacaatagtctccagcttctgggatatatggtgatacaatttatagggaacatggcagggagagtaggttttgagcaagccagaagcagctgtgggaagcagttggtgaaggttagaatctccctgtgtgcagtaggtaggtggctatggaaggagggcggtcagggcaagggcagggctggatctgaagtttgactctgaagagcaatgtgtaaatagcttccatcttagggttgacttcctatacagctaaaatagttattctgtctgctcacttttacttgtccttgtaggggctttaggaatatcctgggtgaaatactattgccagtatgagaaagagaccaaaacactgaccatgacgcctatggagcagaagccaggtgctaagcaggtcagttcttgtttgcaccatatttttggaaatggatctatgactgtttctcagaaaagaatatatgttgacctagtatcaaatcatcaagttcatcactgttacgtgaggccatgactttatatgtacaccttggcctaagtttgagtcagatagcactgagttgagtgaaaaatttctctgttgattagagcaagccttttgaaagtgccggtagtctttcaaaccagttatttttacaagtgccagtcacattgtacagtcaactatgtaaaaatatggatgaattacttttaagaatgctctactcttggattctttaaaatagcaagttttaaaaatatgaattgaattccaaaattccttttttacaggagtgtgtttatggcccacagttggaataaccgatactcacattctatgtactactcaaatatctttaagcagttaatctctctttttctgccctccaaaccttctctcactcctgaaaatgacaagataaatttaacacactgaaaaaaatagtttacttacctggaagaacctgatcttttacaaacacacacacacacacacacacacacacacactcacacacactcacacacacagatacacacatgggggttccttaagataaaagctgatctttagacagattgtttatattctaaaagtagttcaatgtgcctctttcccctttaactggctctcagacagggtcttagtgcatgatttttaagcatttgcactctttacaaattgtttgttggaagtgcttcaagggttatttgttagcactgaaagtagtacatgaagacccaatttaggtagggaggaatttggagaaaaattgggacagtttctctcccttgctgatccttttcatggaagatctctcttgtgtggcttgctcatgttgaattagagaggatggaaatgtgctttcaggctactgaaatttttttggagtgagagtggtcttttaaccacaagatttagctccctgctttaatgtgctttggtgatgggatggacttgtaaaagatgttgtatcaaacagagtttctggaatcctcggctatgctttattattattgttattattattattattatttgcgatggagcttcactcttgtcgcccaggctggagtgcaatggcacaatctcggctcacagcaacctccacctcccgggttcaagcgattctcctgcctcagcctcttgagcagctggtattacaggtgtgcaccaccacacccagctaatttttgtatttttagtagagatggagtttcaccatgttggctaggctgatctcgaattcccgacctcaggtgatcctcccgccttggcctcccaaattgctgggattacacgtgtgagccacggtgccagttactgtgcttttatcatgggccagttactcattcaaaaccctcctcagtttccagtccgccagttgccaaagcacctttcagtgtggttccaataaattcatcctgtgttttagcactgatttgttccaagtcagtcagaacttagctgattaatctgactaggaagtgcttataagcaacactggcctgcagtctctttcttttatttttctacacacattacttttcaaataccggagaggaaagctccttttgtaggcagtaatttcatttaggcactttctctgaggctgctcagaggtgcttattgcaaactccaagacagagtcagcagataccactttcatatcctcctgacagatgccagcaagccctccttttagtttttctttccctcttctcttttcattgagtagctgcttgcaaaactgcaatggtggtggcctgagcatttttgatgtggtattccttatggaatggaaagaagaacttagttactcacaaggcagagggaggtggtgggggttacttggatttccccaaattggagttggaagtgatttcttcctgtcagttctctgtttcacttcttaatactagtttgtattttacaattataaattttacaaataaatgataccataataataagaacactacaaaagccactatttcttgaatacctgctgtgtgccggacactgagctagacccttctgtcatattcatgctcctcatttaccctcctagcagctatgtgaagtcagtgcccccaatttgtgtaggaagtgagaccaagttgaagatgcaggaattggccatctttctgactatggcacttactatagcgttggtcccactactttagcctgtcagctctcatctgtgttttcatggtcaattttctgatcatcttctcaaatgataatttattagatcttcatcccttccctgttaggaatttgtggtcagaagaaggagtactgcattctgaatcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgcagaataagtaagagtttagtcagacaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaggtccctgagctgcaatgtcattgaagctgaggacattgagaatttaaagagatagagtgagtctgtgactttgctcataactctcattttgaaagactaatgtgtgacatcccacatttaggggtaggaaggcatactgaaggattaatttagagttgagttgttatagtgcaggagcaaggaaagattggcctgcaagtggctgagtatgctgatgagcaagaagtattgggtaatgagccacgtgggccagtttgtatgtcatagtatctaggcacctgggcagtgttacctaacttgagataccacagtgggttttgttattcccatttaatagattgtgaagttaagacttagagatggaatatgatttatttatttatttatttttgagacagaatctcactttgtcacccaggctggagtgcagtggcacgatcttggcgcactgcagcctctgcctcccggtttcaagcgattctcctgcctcagcctcccaagtagctgggattacaggcgcccaccactgtgcctaatttttgtatttttagtagagacggggttttgccatgttgaccaggctggtctccaactcctgacctcaggtgatccacctgccttggcctcccaaagtgctgggattacaggcatgacctgctgtgttttggccagggtcacatagctggtaaatggcataactgagacaagaccctaggtcttaaactttctagtgtgttgctatttccactataccaatttggatgactttgggtatgctgctttacttctttaagtgtcacttctctataatggttgttaacaataaaagtggcttaaaaatacctagcataggctggacacagtggctcacgcctgtaatcccagcactttgggaggctgaggtgggtggatcacgaggtcaggagttcgagaccaccctgaccaacatggtgaaatcccgtctctactaaaaatacaaaaattagccgggcatggtgcgcacctgtaatcccagctactcaggaggctgaggcaggagaatcgcttgaacccgggaggcggaggttgcagtgagctgatatcgcactactgtattctagtctgagtgacagagcaagactacgtctcaaaaaaaaaaaaatgtagcgtaatatatggcacatagtaagtgataaatgttacttctctttcctgtatcacatggtctctgttgagataagagagggaatctgaacaaggtgagactagaattttagtctgtggacacagtgggttttaattcccttaattacctacaggactaaagtgggccacactgtccttgctgcacatatgaaatatcaaatgctaccatgactaatacacacatttgctatttcctctacttttgcgctacctttggagcgattacatttgtgatttctgtcatcctaaagagtctagagttgggagacagaaatgtttttctccctccttcatctgccactttaatggaagcttctttgctcagctaccctctgactttctaagggaggttttagacagccacttaccccgtcacaatttccctccccagaggcctcatgaaaattttattctgtacacttaatgccattcagtcagcccatttctcctacactccccttacatgatatgtattgagcttcctattaagtcttccgtcttgggaaagagtgctggatgactctgaacaatttctcctggtctcagccattgattcttggagcggggagaaaccatctgccatcttgctgcaaatactgtttgaagggacaagattctcagtgagtctacacattgctcctgctgccttgaccagacgccttccaagtgacactgaagacactgtaggaagcagaaacagcttctgtgtctttttttaaaaattgcctgttaattcttgtttcatatcaggggcccttggacttaacactgaagtactgtgtgagaaggaagacggagtctatcgacaagaggttctgttttgacatagaaactaatgaaaggtaagctgtgccgctgtgaattggcaatgtccccacgtgccagatgcttagcctgggtaggtcttttattttcctccgtcatcccacgttgatgacaatgagtaagtctattcaggactttgttgtgagtctattcaagccagctcttctggctgcccttcccagggatccctgctagacctggcccagtgctgcttttctctgtgcaagcttctatcagctttgcctcacttgctctgggaagaaaaagtctctcctgggatttaatttgctatcagatgtgcaaaaggtcaacatttggtgatcttgcaagaaggaaaggataacaaagctcattctttgttaaatctcctaatatcacataaaagaacaaatgaattggcacacatttttgagggagggaagatggggtggagggtcgtggtgttattagaaagtcatttccccccatttggtgcaaaaatgatgcagaccttccctactttacagatactcaatgaactggaaatagtgtgattatcacctttcagatcttacagctaaggcttgcacattttggacttcgttgtgtttgtttctccccagtgccctctttttttacttgaacctgagcagttttatcagaggagaattttaaccattaaaatttcaaatgaatgcatttggcattattgtggagaaagacatgctttatagttgggtggttgtaccaaaataaacagaataaatctgtttctagattttatctcaaccttttatttctagatgttagatacttagtaatagaatagaattttgcaaaatgatcagattgctagaaaggaacttgaagggtgaattacaatatcatgtgaacaaaactagcagtgactgggatcataacaatcagactaaatgatgagggcatttttaaaaaaattggggaataaaggacttagcttgtttcattatttcaaaattgagagattattatttgaccctcacaatttcgatttgtgaatttatatcatttctttgttaaaaatggatgatcccaattgaggtggctctgaaagtacgtattgttgccagtaaccatgagactgtcactcattttcctgatagcctcagttccagtaggaaggggaaaattattgttggctgtggcttcccttttttgcaaataatatccccaactcaagcagttgcaaacagtttgtccccgtggttaggggctaggatgaatttatgtttcttgtacctggtgctatgcatggctcatgataagtactaaatttgatgtttatttttaagtgtttttttcttatcctagaatgctgaagaattttcgacactagaacccagggattaaagttttgatgcatctacacttttagttatcatatactgtgcactttacaaaacattccctcatttaatctacaccccccccattttaccagtgaggaaactgagacccacatatatttaactgacttgcccaactaaagtcacataggaaatggtgaggctgagctcaaaccctggtctgtaggtctccaaagcccatgctggtttctttttgtttgttttgagatggtgtctctctctcttgcccaggctggagtgcagtgttgcacaacctctacctcctgggctcaaacgagtctcctgcctcagcctcctgagtagctgggactacaggcgtgtgccaccatgtccagctaatttttgtatttttaatagaaatggggtttcaccatgttggccaggcttgacttgaactcctggcctcaagacatccacctgcctcggcctcccagagtgctgggattataggcgtgagccactatgcctggctccatgctgtttttaattttttatattgtctattataagcagaagaaacaagctgcaaagtagagcgttaaatataataatgaacaggtgctgaggcccctctctgcatgtggagtcttttgagtgacatgacatctgcttttctggctagtcagtctgatataaggaacagagtcaggcttcctagcaggcatcaggcagctgtactcacattccctggagcacagagcaaagggctcttggagccactttttctatgtcaggaagagaggataagattttttatttttttaacttttaattttttagagagagggtcttactctgttgcccaggttggtttgcagtggcacaggttcaagtgatcctcttgcgtgagcctcctgagtagctgggactgacaggtgtgcaccaccatatctggctaattttttattttttatagctatgggaccttgctatgttgcccaggctggtcttcaactcctggcttgcagtgattctcctgtgccagcctcccaaagtgctcatattacaggtgtgagtcactgcacctggttctaaatttaggctcttagcagtatttaaaatgacaggctcatagcaaggcagagcttgaaatgttttaataacagcaacaacaataattgtaataataataaaaacaattgctaacatttgccaagtacctcctttgtgacaggcactgttatcagccatttaagcgtataatttcctttagtcgtcaccacagtcacatgagggaggtgatgttatttgaattttggtttgtgaatctgtatcatttttgtgttaacaatggatgaccccattcaagatggctgtggaagtatatattgttgccagtaaccacaagactgtcattaagaggtgctttaatgaagtaagagaaggtaggacaggaaccccatgattccagcaggtagaacaggattcctgtgatatcagtaatggaaaggacctcccagctcctgtgttccagaaccctttcagataaagaaactgaggtctagaaaggcctagttacttatccagggtggctgaactctcttggcattgcttttatcattctatgactctaggagaggtctcatcttatcacagaatttgtggaaggaacaatgttttcctaatggctcagcaagccaggagaatgcaaggagactttataccttgcataaagtatggttaatctcaaaattccagatgagtcacaaagatctaaaaagaccataaagagcataacagcttgggatatctctgggtagttagtagtgtcttagtccatttgtgatgttatgacaaaatacctgagactcagtaatgtataaacaacagaaattcatttgtcacatttctagaagctggaagtccaagcagtttcagtgtctggtgagggcctggtctctgtttccaagatggcatcttgttgcagtgccctccagagagcaccaacaccgtgtcctcatatgtcagaagagatggaagggaatgaacctactctttcaagtttttgtaaaagggccctaatcccattcatgaggttctacccttatgactaactcacctcctaaaggtcccatttcttaatatcatcacattggtagttaactttcaacctatgaattttggggaatattcagaccacagcaggtagcctgcaaataaatagaataaaacagggttcgaagccgtgtgccaggcagaagaggccttatattgtagtaatgaagaatatggctgctggaccagactttctggatttaattcctgtctctagtagttccctgctatatgaccttggataattactctgtgcctcagtttccccttctgtgaaatagagatgattactgtaactgccttattatatatattaactgagttaatatacatagtttacttggaacaaaatttgtcacctagtaagcattcagtaaatattagttgtttttattagtcataaaattgcttattagccaaaacgcctcctccctgtgtcttagccagtactcatgttgttgaatttattgcaactcaaaatgtttcttggacatcgcaggtgctggaagaagcaaagccattttactgagagataatgtgcctctgatgttcatgctcattcctagagctcagacaaagtggctggcttccaacagagtaaggcagtgagagcctttgtttggttcaagcacaatggggccaatttaagtgtgcattatggaggcgtcttgacagttaccttcctatttcttgcaggatctgggcacaaggccaccaagataccacccccgcctccatggttcccaaagttactgttctgtaaattgcctattgttttcttgagtaaaagagattttgaaaaattagtattctgtaagcctatgcttgttcagtgtgacaaactccagggcagagagggaccctagatcacaagactccattctctcagttgaattttctgctttatacttaccatttttttccccctcaggccaggaaccatcactctgcaggccctttcagaagctaacagaaggctatggatggaagccatggatgggaaagaacctgtaagttacctgacactggggaaacctccccagcatatgccagtgtatgagtgccctctagtggtatcagtgggtctcagacaattaaatggtaatggattgtttagtctcagttttagagctgtaaggaattgtttccacatctcttagcaggtaaggcaactggagttccagaaaggttgagggacttttctgagaccaccctcagagaagacaccaaaaccgggcttagaatgcagatctctcagctccctgctctagtgttagactatgtagctatgcccatgagcttttcttcagaaagaatgaagccatttttcaggttataaaatcaatatgtgttaattaattaatatgtgttaatatgaaaaataattgccatagttataaataagcacttattaaacatttattcagaatgatttttctgcctcacccttataccaccaactcagcttattctctttgagggtacagctggtagcggagatggcattgccatcctgtatcacaagatgtaccgttccatttagaacacggttatgcaggaggacaagcaatcccttgaaagggttactgattatcatcaagcgaccaatagaaacagttggaaataattgaaaaacattctggtttcttagtggcatattaaataatatcagcttcctggtgttggaattccaaaagcttggatataggtactagttctgccattaaatggctatgtgactctgggcaaatcatttcacctctctgagattcagttttcttctcctcagtaaaagggctttaataatttctttctacctatctcacagggttgcttagaaaaaacagatggaagtcatcttgtaaaccacaatgtgctagccgatctgaatgatgggatacaaaactcctaagatccagcagtgttcagatacagtcttatttctttgctgtattcaagtgaaaaactggctaggagggaaaatgcattctaggtttttctttctatgtgtcctcagtatcctggagaatttagaggggtaactagatcccagattgcacttatagtaaactggaaggtagcaggagagacttggtattctgaagactgccatccagaaaatattccagcactgtcttccttctgtcaccttccagaaacctgctgctgaactctttcatgcttgtgacatttctgtaggcagatgctgggaagctcagcaaggcatttatctttcaattccctctcccaagtttgctctccctttaggttttcaagaatcaaaggatgcagatggctttctgtggagaatgatgtgagcacatgggcccactgaatgtggatccataccaacttgatcatggcagatttttccacaaatcccttgtttagaaaagtagcagaaaaggctggctggcacaaaaatatctcccactgaaatatctgtgggcatacacacatatgcagaacttattttaaggagaggctgttcaaacagactcttaacagatggcatatagagggctcatttcctgcaacctcacattactaatgttgttgctcctttactaaacactccagttcactagtcttacaaatctcatccatgcctttgcctaaactgtcaaagaagatcagggcttgaaggaatgtctactccaaccctgatcactttactgatataaattttgagatctggagaatggaaagggcatgcccaaaatttcctaagaggtagaggtagagccaggactagacttcaagagtcaacagtcttctttctggtctctcacatagctatcacagcacatactccaagacaacacagacaaatcttggtgtattcatggatctctttcagatggacatttgcctttccacagagaagtattcatcaaccagtctttgagggtgggagattggtgttaggaacatttaaattttataatgcccattagacaggtacatagccatgaggaaaacactttcctggtctcttgctttatcataaaaatgccccaggtgttacataagtaaatatctaagatggattagctaaaactgtagctatggtgaactgtgtgaaattcagtgtaattttcagggattgttcaagtattttctttctttcttccttccttccttccttccttccttccttccttccttccttccttccttccttccttcctttctttctctctctctctttctttctttcttttttttttgacagagtctcgctctgttgcccaggttggagtgcagtggtgtgatctcagctcactgcagcctccacctcctgggttcaagagattctcctgactcaacctcccaaacagctgggattacaggtgcacgccaccatgcctggctaatttttggatttttgtagagatggggtttcatgatgtttgccaggctggtcttaaactcctgacctcaagtgatctgcctgccttggcctcccaaattgctgggattacaggcatgagccaccacgcctggcctgttcaagtattttctagcaatcttggcaaagcaattatgtttagcccacttggctatctttttaacatcctggagtttctaatcatttttaatgcctatctggggaaagatatttaatattatgttctctgttttcctatattgattgacaatagccatggatctttctgtttatcttcttttgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagacacttggtgttagcttacatcgtgggtagagaaacatatccttcctgttctggaagcatgatagaaattgtatttttaggctaacatttcacatatgactttgctcatgctgaaagcagacaattcaaagggctaaatataagtattttgtgttataagagttaaaatgttaaacctcccctgaaaaaatgactctttccatttaagggtgactagaaatgagcaactaaaaacccttagctctctcaatgcagtccctttgcatggtcattaaatgtttaataggtgacacctgttgcagcaggatctaactcttttcctttgcttgaaacagtggagctaaatgaagtgggcttcaagtttgtcaggaagtgcatcaatattattgagaccaaaggtaagatctgaaccatagtcttggcattgtctgaatctcgtcactctgattttatcctgggcaatttctctgaagtagcgttttaggaatgaagactgtttataaagcttgtgtagtagatgcaagctagaaaatttcagaaaattctaaactagtggtatgcaagcatatttggataatttggattcctgcttttaaagagcttataagtttataaagtattctcaaacagtacctggcactccttaagcagtgtcatgatggttctatcctaaatgatcaagagttcaatttctgccacagtacatactggtatgaaaattgatggggcagagccaaactcagggagatgtggaatcagcattcttcctggttgccgatactccctggtttccttctgaggatatttagactgtgggcaagtgtggtatgtgaatcaagtctctttgttctttgaaatgtttttttagtctttcttggtgcaggaaatggccttttgtttcacagctgccttactccagccctctcgtgatttatatcactgcttagaagcaacttgagggttgatccttcctcctttttcaattgaatgaacttctttctaagatggcagcaccattctcagctttctgctgccgcccaaactaagcatatgcttctatttactatagagtttgttttcttctcttcagattaatgagggtttggtacactccaaatgaaaggatggataatttggagagatgctgtaggactattcccctgttacagggaaggctggagaacttggagtatgtagtgtgaccccttcctatctgaattgaccctagtgtaccaaggggagatgacaactctagctatacaagtgaaattaacctgattttttcctccactagggatcaagacagaagggttgtaccgcactgtgggcagcaatattcaggttcagaagctgctgaatgccttttttggtaacaattttactttgataattcttattgggagtactttatgtgttacaaagaaatgtgactggaagagaaaggagacactgctaaaatgtggtagaatagttgaaaaaagtattttctaaagtaaaacatacacatacttgcccaccctgggcagagtcaatcgtaccttgaaaatggctgttatctctccttcctcgtatcccattcactccagaaaccctcagcaatacaacttctttccctacatctcaactggaactgtgtggccaggcttagtcggtatcttcttaccaaatccagtgaatacttttgagtttgtgtcttacttgatctccttgttgaccactttctcttttttgaaactttctccttacatgacttcgtgacttccataacacatcagcactcttctgattcttctcacatcttttttttttttttttgagacagggtctagctctgtcgcctaggctggagtgcagtggcatgatcatggctcactgcatcctcaacctgagcctcctgggtagctgggactataggcgtgtgccactacaccaggctgatttttaatttttttgtagtgatggggtctcactatattgcctaggctggtcttgaacttctggccttcaatcatcctcttgcctttgcctcccaaagtgctgggattacaggcatgagccacaatgcctgacctcttctaacatcttataggattccttttcaataacttgctgaacctttatctttctgttttttacaccttgactgtgtgtttcctacagttctatctttgttcttggtttacttctttttttttaatatgtttttctattgattgatttttttttattctggttatggctcacatttttgtttcttaaaaaacatttcttgtaatctttattggttgctggatgttgtgacttactgaatgtcttgattttgttgatttcttttaaagaggactgaattttgttttgtgggcagttatttgtggatcaatttgatttatttgagtcttctttttaagctttgttgggccagatataaagtatccacccccaggtaaggttgttgagctctttttccacatagctcactcttctctggtactgtgccttgctagttatagctgcttcaaccttcctaaactttgatccttatctcttcagctgagcaagacttccatgctcagcttgagttcccactccatctgctgcaatctaaaaagtgcttttaagaagcaagctgtggagaaggtagcagttatcttgtttgtatccctcttctcagagtcatagtcctgttttgtctgttgctcaataactacatgcaggagtttcctatatactgtccagttttctagttgttacagcaggaaggcaagtctgataccagttagtccaccatggctggcagtggtattctctctttatgctttttactagcacctctatgctgacaactcacaaaatctctgttccagacatcatctgatgagttctaaatgcaaatattcacttgcccactgcacttgtgcttctcagtcatattaaggtcatggcacatatcagaatgatcatctttatatagcatgctcgggtaaatggacatcactgaggcaagaagccctaaaggctgagggagtcaatattggagtctctgcacaagctctctttacatagatggttcacaggtatctacctgcatttctctccctgcaaacctacccttcttcctttcgtgggtggcagtgaagcatcttgtaagctgagttttcacagtgtcagagaacaaattgagtgtggaaaactgcagtttggataaaatacatattttttggtccttactgtgatgcatagctaatctctcacaagcctgcaggtctgacaaccaaccctactcacatttgaggatgttacagcactcagtcatagcaggtgtggtttttgaattccagattacatcattagtacctcatcatctgttttcattaatcaccttacattcttgacttttaaaaatttggattgcttattcctggtcaatttgcaacccatctcattagctaaggacactttttcatatgtaaatcagctgacatcgtggtccagcatattgaatctctgaaaaattattgaactcagatatttattcagataactattgaactattgaaaattctgtttccagtatcactcttatatctgttgtataataagctaaaaaatgccatgccaggcatcccactgattctcttatgggctttaataggactgaagtggctccttcaaatcacacacggcagtagaatttgattcaagtattaaggaaagtggtagagttggtgtatttcatttattcaaaaccatcctccaaatattaactctcataggaatatctaaaatatagaccaggaagttctagatataaatattgatagatgcaatataaaactgttaacttccttatttgtatatgaaagtggcaaccccgatccctgccccaaatgtatgaaactccagatgtggtgatgatcctcattcatttattcattgagcaaatatttgtgtgcctacccgggcatcaatcattgtgtttagggcagtggattgaaaagtgaacatattccctgtgttttccacctttgtggggcttacattctactgggaaactgtctctcagttacctttcaatgtctagttatgtggggagaccttccttctaagtttatttcatgtgatgtcctctggcgtgtctcactgggatcctcaaagctgtcttgcttcttttcaccctttcctgatctagtctcataccactaggggcttgttgccttggctgcatgtggacccatcatgatttatcctggagggtgaacatccattgccttttggttacgtaacatctctccctctttttttttttcttatgtctcatgctctgtgctagtcaaaaggatacttcttgttatttttttttacctaaacaaccctcagacttctttccctatgacatctcctataacttgtaactgtaggctttcttctatcgtttactaaagccttttcttcttcccctagacaaaagtttgtctttttgggaaataaaatatatcacagagtataaagtcaaaggcaatacattcataatcaatagttattttcaatcacgctgttggttggttggtcacattccttgcctacaccagatttttgtatgatgctttatgttaataggttttatgtgaggattagaatcttcactggtgctggatccattgtaagccaccttggcacagagaagccaatctgattatctcagggacaacttggaacctcgtgtaagagttctgtttcagaaggggaacatcacacactggggcctgttgtggggttgggggaggtgggagggatagcattaggagatatacctaatgtaaatgatgagttaatgggtgcagcacaccaagatggcacatgtatacatatgtaacaaacctgcacgttgtgcacatgtaccctagaacttaaagtataaaaaaaaaattaaaaaaaagtttaaatcataaaaaaagagttctgtttctctttcctttatcaagctataactatcttattaatgaaaatgccccccattgtcgttatagtcttaataatcatgttgtgctccagagactcttaagtatttcacaatggagcagatgggtgagatggggcatggacagcaatgagactggttgtatcagcaggggctcttgatagagttgagcctggttggcagccataaacaggaaagtgttgttctcacaatccccttaccatgccagaggcctatggatctaaacagaagaggacctgctgtaacgagtgaagtaacaagtcacttgtaagatgttatttatgttattttcatttcctgtttagatatttaaatttcttatttcatcattatggcattagaataagatacgtggacttctcagaaactaagtggaatacctaatatatatagacagataatagagtaggaatatgcatacagtcatttttccattttcataattaatgtgaattattcagcatctggagacttaactttagcattaaattcacatatattcggacaaatagataataaatacattaatcagaaatactttcaagttatgtgacctctttgtttgaatgagaaattcagagtcccctagcaaataaaacaaaaatataccacactccacttcaggagttgcagaacttgaactctatatgttaatctttaaagcaactgtatatgttaaccgtttttctgatactgtcgtatgatgtgatctttagctttccatacatatcaagatactttattcataaagccagatccttgtatatgtgtgtatatgtatacatgtatgtcataaatagattttatataggttcattaatcattactatacttactactttaaatacattgattattctcaaatcatgcttgctttgaaatagtaccactagagtttgaagtaatttatcaatggatatttactgttaccctttccaaattatttcctatttgcatttgactatgaaactgagttcaaaaacttttagaaataaagtttgtgatatgaatatttgttccttttctattattttctcaatatgtgaataattgatagcaaattcatctttagttctcacctgacataatgccatttcctagcattcttgtaagtatgtaaacagtaggataggaatttttctcttaaaggtattttaacttagcaaaaataatttcagttgttgacatatgaatctagcaatgctgttatcccacctgcttcctgctgcagggtttctgacttggggagagtctttcagctatgtcaccatgaatgaagatccaggggattgtttgtattagtttcctagtgctgctgtagtaaattatcacaaatttaatggcttaaaacaatacatatttggctgggcacggtggctcacacctgtaatccccgcactttgggaggccaaggcgggcggatcacgaggtcaggagatcgagaccatcctggctaacatggtgaaaccccatctctactaaaaatacaaaaaattagccgggtgtggtggcgggcacctgtagtcccagctaatcgggaggctgaggcaggagaatggcgtaaacctgggaggcagagcttgcagtgagctgagatggcaccactgcactccagcctgggcgacagagcaagactccacctcaaacaagcaaacaaacaaacaaacaaacaaaaaaccaatacgaatttatcctcttatagttctggaggtcagtagcctaaaatcattcttctggagctaaaatcaaggtgtcagcaaggctactttttttttttttttggagaagacagtctgttcccttaccttttcagcttctagaactttccttgtctcatggtccactttaacaacaccaggcagagtccctctcatgctgccatcactctggttctttctcttctgccttcctcttctgctttaaaggacccttgtgattacattcattccacccagatcatcagaataatcttcctatctcaaggtcatctgattagtgaccttaaacctatctgtaaccttaattctcctttggcatgtgacttaacatattcccaggttcctgatattagtatgtggacacctttgggaaccagaaatctgcctactacatacactattccattcagagttttaggacactccctctgatgctgttaagtggaccccgaggtcattcttgattcttcctttttggaatctgtggtaagacctttaggcagtggttatcttattgacttatgactcattgtgacgttctcacttacttcctcaaaaggagcagaaataaattcctttcattggcatatgacatctgttagggagtgaatgtttgtacttcctcccccatttatatgttgaaagtgactccccagtattggtattggttttggaggtggggcctttgtggagtaatttgggttgaataagatcataaggatggggccttcatgaatgggataaatacccttataagaaggtgccagagggctagcttactctctttacaccatatgaagatgtaacctggaaaaggtccctcatcagaacccaaccatactggcacccttatcttagactttcagcttctagagctgtgacaaataaatttctgttgtttataagccactcagtctctggtaatttgttatagtagcctgaaatgactaagataccatgttttccaagatgtctcagctctttgccagccagagtatcatttacacttttctctggagaaacttgttctgtactcagtctgttcactttttttcctatggcacttctttttgccactagcttttttttttttttactgtaatattgtcaaacatgctgtatcccagagccagtttcaggtgatctgcctgaaatggattgtggacccagagcaaccaatttaccctcttgatttctgttggtaatactaggatccccagagcccccattttgagccaggttaggcagatgaactatgccctgagcatctcttatgtcctgcagtgttcattctttcattcattcaacatagtaatcttgagtacctcctaagtgccagatattgtatcaagtggtagggatgtaacagtgaagaatggggaaagaaatcaccagcctcctgcaacttagtgtctagcagcagctatagttcatagatacagtcacatatttttctcccaaaataaactctggaatatcccagatttgggattctgttgatcctcactggcagcataaggacatgaagcagtataggcaactggaaaagagaaaccatagtcttccccttggaaaaaagcagcctatttcttaaaccaagatctttcaccatcttaatgtaaagcatataaggagaatatattaactttgggagactgtaacagttttcctttttctgatgtgtaatgtataccttatttcatctgcttgaactccattggctttcaattttttccaggtcttattgtttatcttctgccttgcctcatgatcccctttctccttttctttagccttgtcttacagctctctctctcattcactgattcacacaacatttattcactgcatacgctagtgtttagggctactgcttacctccctttctctttttttttctcttattcttcacatatctcctttgcctcctattctgacatgcttatactatgactagcaacccgctttcataaaatcttttctatgagcatacattggaacccttctagatacaagtagccagacaaggtgatcataaatgaaagactagtcttccctatatcaaatgtagctgtcatctgggaaaactgcatttacaaaatgcccaggtgggtagtacatgctctgacatttctctgtccatgtttctttactagatgcctggatctctaggaatctggtattcagcatagtggatgacacgtaggaaatatttgtggaattaatgaatactttttgtgatgcatgtctcttcctagagaatgtttgtttttctcaaaaacatgagccattccatacatggttgtattttgttatgctactgcacagagtttctgttgtatgtagtttcacaaaatatagcttttgttaatctctgcagatagtattaggaccaccaagttatctgaactgacatgtaattaatatttgcaaataacgataataagcagcaaatcagtaggattttcccatgggaagccatatttctcaaagatttctacatcctagtcagaggtgattcttcatttaaactgtgtagatgataatgggcaaagggaaattgtagcttcttttctctgttggagggcatgttttatttcttcttgttgttgccttcatcttttccccagtgcttcctgtgttgaccagatgatcacatccagctttaaaaccattcatggggatagtggctcaagccggtaatcccagcactttgggagaccgagacgggcagatcacttgaggtcaggagttcaagaccagcctggccaacatggtgaaaccccatctctactaaaaatacaaaattagccaggcatggtggtgggcgcctgtaatcccagctactctggaggctgaggcaggagaatcgcttgaacctgggaggcggaggttgcagtgagccaagatcatgccattgcactccagcctgggcaacaacagtaagactctctcaaaacaaaacaaaacaaatcaaaacaaaaacatttgtatctgaatacagtgttgatccatcttcccaccccttccttttttttttttttcttttgagacggagtctcgctctgtcacccaggccggagtgcagtgacgtgatctcagctcaccacagcctccgcctcctgggtttaagcgattctcctgcctcagcctcccaagcagctgggattacaagcatgtgccaccacacctggctaatttttgtatttttagtagagacagggtttcaccatgttggccaggctggtctcgaactcttgacctcaggtgatctgccagcctcggcctcccaaagtgctgggattacaggcatgagccacagcgcccggccccattcctctttttgactcattgccttttattttttttattactattatactttaagttttagggtacatgtgcacaacgtgcaggtttgttacatatgtatacatgtgccatgttggtgtgctgcacccattaacttgtcatttagcattaggtatatcttctgatgctatccctcccccctccgactcattgccttttaaagcatgctgtggtctccctctagtggagaaattgccatttcagaaagaaaaaaattcacagcctagagtcaggttatatttgttatgcctttatatttgaacaccttgtaaattgctgcttatcagtcaattttctgtttaggtgttgtagagtaaaaaacaatttttcttcaactctcgtaagttcttagtcagaacatacccttgtaacaaaagacaagattagtaggagaaaacaagctaattaatacgtatatttcatgcatacatgggggatacccaggaaatgagtaattctcaaagaggtagctttaaatttcaggttatagatcaccttcaacaaagaatagtaattttttaattgtattttttttaaagatgtgacaagacaaagtaaaaggactttgaatctctagtggcagcaacatctgggaagccaaataaatgagagatgacagctagttagtaaggcttgtttatataaattcctctgctaccatttctaggccaataagtgtctaaagttgtctttagtggttaacctttttaacctttgttctccctggtagaaaggggtgttgggttgggataccttcgtctttgtaaatctatgttctgcttttaggcaaatagagggagggcagagagctttcctgtacctgctgcttcttaattttcttcaggtcaacaattctttgtattttggggtggcatattatgaccttccatagtattgtatcttctgaagccaaacctcatcttactcaaaacagttaatcacctcctcttctctaccagttatgtacttagtgtaatttatattattgtagatttcttgctgttatgtagttacttctgggtatatctgttctgcttcacacttcagcatcttgagtagaatttcttaatcttgattgacaatcctatccagaatttccagaatgtttagtttaatggagtgttattatgggcctttgtattttccatgtccctctgaaattcctggaaatgtctgaaatttggaacagatactgttgtcagcaagttacctgaatggatatgtaaaaagcaggggtggcagagcttcttgggcagagcctctgttttttctttttctttttatcttttgacagagtctcactctgttgcccaggctggagtgcagtgacacaatcttggctcattgcaacctctgactcccgggttcaagcgatccttgtgcctcaacctccagagtagctgggactacaggcacccgccaccaggcctggataatttttgtattttttggtagaaacagggttttaccatgctggccaggctggtctggaactcctaacctcaagtgatccgcccatcttggcctcccaaagtgctgggattacaggcgtgagccactgcgcccggccagaccctctgttttcaacaacttcagtatttccatggagttccctaggcccattcattatcttttcacagcctcagcttggtgctcttatctctgggtaccttttagacattaacaacccatacctcttagatttctgaaaaggccaaaggaagatcttgtagttccacttctttgtttcttatgagtctttcttctccctccttccctcccttcctcccttcccctctctctttctctctgtctctctctcattatcctcttactcttcagagtcttcctgtcctgagaggcctttattccccagcagttcattatccaaggaccatgcatgttcctgagaggaacatgggtaggaccccctcagtgggtattggttgtttcaactaccccctagtggagaaactaccatcataggaaaaaaaaaaaaaaaaaaaaaaactacagagcttctatgtcagtcccaagattttatcaaattgtaattatttgtacactcccagtctgttcctcactccggtgcctaaggtgtagccattgttctatgtccatatgtacccaccagtcgtccgggagatcctaccactatcaagccaactgttgagtttgatagttaatttgccttctgcagagatgaaatacttgctttaatggctttggccatctagcctctggccagagttctagacataggatttgtgaacaccatggacttgaactcaggatttagatgtaagtggaaagtgacactaagataaagatggaatagggttgccaaatttatttattatgtatttatttattgatggagtcttgctctgttgcccaggctggagtgcagtggcgcaatcttagctcactgcaacctctgcctcccaggttcaagcaattctcctgcctcaacctcccaagtagctgtgattatgggcacctggccccatgcccggctaattttttttaaatttttagtagagacagtgtttcaccatgttggccgggctggtctcaaagtcctgacctcaagtgatccacctgcctcggcctcttaaagtgctcggattacaggcgtgaaccaccattcctggcctagggatgccaaatttagcaggtgaaaaacctagggttgccagatttagcaggtgaaaaacgaaatacagaatgctcagttaaaattcaaattcagataaacagatttaggacacacttacactaagaaaaaaatagccattgtttataagcaattcatatttaactggaaattctgaattttatctggcaattttaatctggttccagattttgcaggatcttatcagtcatgtgaaggattttagtccttagtatgtataatagcaatgagaaacggcagagggattttaaacagggaatttgtatcttgtcaaataatgattcgaacaggccaccaaaatagtcttctgatcaaacaaattcaggcttgttacttacagcactaaggaaggccactaccattgcaatattgtcttaataacctttcagaaggggaaaatcagatgtggagggattcatatttataaggtttttggagtctggtttgtggcaggtctttcattgttggggcctgaatgattgagattggacaaacttcatgatataattttatgtcaaaattatatcaaagtttgtgatatatttttttcaatagtttttatgtaaaactttgaagagtatcagtcatttgataaacccatttgagagatgttctgagaagtggctgtttactcagatgaggactgcttgataagcattgttcagaaaaattgatttccaggaagtttctgaaacaaagctattcacaacttcctcttactggaagaaatttcctggaatagtagttgaagttaatgcaaagtattaaatagaaacgtcatattaatgtgggtggtaaactgtatgcctgcctttggttccggttctctttagcctctgctggttattcttcagtcttagatgagcttcacaaactgtatgttcatggcacacttagtttcagtctaagtaatttgccagggtatctgtagtccaagagatgtacctaacgtctccatttattaagtaattaagttgaaccaacttagtaagtttgcacattcacacaacttagtagccatatcattcttattgaaagtatttttatcttgtcattaaatgaccctataatctttttaatgctgaatatgtttcagaaacattaatattaaaaataacgattttaataaaaaagatacctgctcatcctaaaaaattttaagcattaaaatgtgttcagaaagcgtagtgaaaattcaccccaaatcctactcaccaggaatacttattttttaacttggtggcctttattctaagtatatttctatgagtatacacataaactattttagaaaatttagatcataattgatgaagaaagaattatccatgatacttggatatagtaaggtagacattttttcaacagagactactgcattggggttttatagtaggaagagagattgagctcaactccaaatacaaggaaatttatatccaaggagcaggatgggtgttatggcttgaatatcccctcccaaactgaagcgtatctgccactataatgttatcaagaggtggagcctttaagaggtgattaagtcatgagggctgtattttcatgagaatgggttagttactgtgagactgggctcctgataaaacaataagtctggcctaattttcactctgtcttgaccaccaacttgcccagctgtcatgggatgatgaacataaagaccctcaccagatgacaatgtcatgctcttggatttcttagcctccaaaatcatgagccaataaactggttcataaattacccagtctgtggtattgttatagcagcagaaaattgactaagacagtgggaagcagtggatggagaaatgctaagaggaaacatcaggagtaaggagagattgtgagtaaactgacttgataggatacttgctcaaagccggatacagtgatcagatacctagagtaggagattttcactaaactgactcagcaggattcttactgaaaccagactatgtgggccaaagacaggacccaaggttgggacctaatcagaaagagaattcagaggaatctgactcaagtttgctcaaggagagaatctttttcataatataaatgttttatattctcagcagtgtcagagaactggacaaagatatacattattgcctctctcagagaataatattctgtaaggactaataaaagaaacatagaactaaggtagaatcataaaaattggaaaggaggaggcaatatccatatgttagagaggctatacttgttagaaaaatcaagagcttcacctaaaaaattcctgagaaggagaatttagtgagatagttgattgaaatttctttcctatatacaacaataaattgtataataaaatggaagaaaaattccctttgaagaaattaaccaaacataaaatacctaggtctaaactgagcaggaaatgtgtaacatctatatggagaaaagcttggaatgctaaaagggaactagagagaaggcttgaatatatacaaacacagagccactttttgaattgggatatccagtgtggtaaatatgtcagtttcttactgtataaatataatgcagtcacgatgaaaaatatctggaaattaatttgtttggaactaaacaatctgcttctgatgtttatatgtatgtatcaccttgagccgagagtcaggaaatatttgaaatagaagaaccatacctagaagtaagatatataagaaagttgcaattgacaaaaacaatttggaatttgtacatgcttagacagtgaaaacagtatagtgaattcaaaagtagacctgggctgggcgcagtggctcacacctgtaatcccagcactttgggaggccgaggtgggtggatcacctgaggtcaggagtttgagaccagcctgatcaacatggtgaagctctgtctctattaaaaatacaaaaattaactggatgtggtggtgcgcacctgtaatctcagctactagggaggctgaggcacaagaattgcttgaacccaggaggcggagcttgcagtgatccaaggtcacgccactgcacttcagcccaggtggtagagagagattacgtctcaaaaaaaccacaaaagtagattcaaatatatgtggcaatttagcgtatgataaaggtagaatttcagatcatttggaatgaagtgtttaattcagtttatagtgttgataactggccatacatttggggaggtatacatttcaccttataaaaccctttgcacaatttgaattttgaactcttcaacaaagagctagtttaaaaaataaattaaagggttgatatgattaggaaatttttaaatgtatatttgtctgtctctgtcaattcaccatgttcacagactaggcaaaggaataaaaatgctgccataggaaaacaaaacctacctaatatagtgtgtaatggggtattttgacatggatatatcagagatcaataaaattctcccaaatgtaagtattaatgttaaaatctccaaacttttctaattgagataatacaaaataacatatacactgccagtcaattggcataacattcctcttaaaatataggtctattctatgagcagctgatatggtttgtatctgtgtccctgcccaaatctcatgttgaatcgtaatctccaatgttggaggtggggcctagtaggagatgattagatcatgggggtgaatttctcgtgaatggtttagcctcatccacttggtgctgttccagtgataatgagtcagttcttgtgacatctggctgttaaaagtgtgtagcacctccccactctctctcttcctcccattctggccacatgaagtgtcaactcccccttcatcttctaccatgatgtaagcttcctgaggcctccccagaaaccgagcagatgttagcaccatgcttcctgtatagcctgcagaaccgtgagccaattaaacctctttttttttaattaaattatgcaatctcaggtatttctttataataatgcaagaataatacagcaactgaccagattatctagctgtgactgtatattcttaaaatttcatatagggttaatcaagcccccatttagggagtatttttgttacttttatttttaattgtggtaaaatatacatgacaaaatttaccatcttaactatttttaagtttattgttcattaatgttcattgtattcacattattttgcaacaaatatgcagagctcttttaattttgggaaactgaaactctgtacaacattaacaactttccatcctcctctctccctagttcttggaaaccaacattctatttcctgtctctatgtgtttgactactctaagtgcctcatataaatgaaatcaaactgtatttgtctttgcgtgactggcttatttcacttggtgtaatatcctctagattcatccatgttgtagaatgttttagaatttccttcattttaaaggccgaataatattccactgtgtgtgtctatgtatgtatgcatatatatatatatatatatgtatatataaaaacaatatgtattgttcattcattcttctgtggatagacacttgggctgcttctaccttttgtccactatgaacaatactgctgtaaacatggatatacaaatatcccttcaagaagctgcttttacttctttaacccatttatgcctagtgttccattattggaatgctaagcatgtaggagttatttatatcttactactcaaggtcatcatcaaggtctgattgcaaaaattcaaaaaaattgcaactgccagcataaatgggtttaagtatatgtcgagaaagtagaattgctgggttatatagtaattctgtttctagttttttaggaaccaccatactatgttgcatagtggctttaccatttcacattgccaccaacagtgcacaagggttccagtttttccacatcctcaccaacactttgaattttccttatttatttatttttgatatgtagccattctaatgggtgtgaggtggtatctcattgtggttttgatttgcattttccatgtgacaatgttgaatatcttttcatgtgctcacgggctatttatttcttttaaggaatgtctattcaaattctttgctcattttagaatcagtttgtttattttttgttgagatttaggaggtctttatatattttcagtattaacccctcatctctaacacacacacgatttacagatattttctcccatttgatgcacagaagtctttaattttgttgtagcccaatttatctattttttccttttctttcttgtgcatttcgtggcatattcaaaaaattattgctaaataaaatgtcatacagttttcccctatgttttcttctaaaagtttcaagcttttgctttcatttgggtctttgatccatttacagttaatttttgatatggtataaggtcaggatccaacttaattcttttgtatgtagatatccagtttctccagcatcatttgtttcaaagactgtcctttacacattagatggtcttggtatctttgttgaaaattattgcaccatatatgttagggattctttctgtgctctctgttctattccaccggactgcaggtctgtctttatgccagtaccacattgttttgagtacgattgctttgtcaaagacaagatgttccagaccattagggaatgtctttatttagactgttgcaatagggagaaccttcattattgaggaatatttcccaggagaaggagatttaaggctttttagaggcagattacaagagagtcatcatgaggcttacatgagtcatgaggtaggatggagatgtgtcctatatgcaaagacagggtagacttttgaagttacttgtttctgaggacacaaaaagatcggggaggtgtggtatttctaaaccattgatgcttccttggagcacagggttcaagtgaagttcatcatggtcactacagtttagtaaactttttttgtctggactttgaatagacaatgatttttttttcctttttcgaagatttaaataggaaaaaaaattcttgtttggtttaagtagttacatttcttttccagcaactctacaatttatttttcccaccacacatattataaatataaccaattatgtactcaaatttctctctgcctttcaaaataatactttgtgactcagaagacattttaaaaaatatacttaaaggaacataattattaggtatgcagtataaatttgctcctaaaactttttccatttttatagttgaaacaatcttacacataatgatgcttatatctactctctgtagggaagaatttgtaattctttcacacaattctgaatattttacaggttttgggggattttttttcttttttttttgagacagagtctcgctctgtcgctaggctggagtgcaatggtgcgacctcggctcactgcaacctccgcctcccaggttccagcaattctcctgcctcagcctcctgagtagctgagattacaggcacccatcaccacgcccagctaatttttgtatttttagtagagatagggtttcatcatgttggccaggctggtcttgaactcctgacctcaggtgattcacctgccttgacctcccaaagtgctgggattacaggtgtgagccactgtgcccggccatttttttggattttaaactaaccattccaggctgggctgagcgattcatacctgtaatcccagcactttaggaggctgaggtgggtggattgcttgagcccaggagttcaagaccagtttgggcaatgtagggagaccctgtctctacaaaatataaaaaaattagctgagtgtggtggcttgggcttatagtcccaactgcctgggaggctgaggtgggaggattgcttatgcacgggaggtcgaggctgcagtaagctgcgattgcaccactgcactccagcctgggtgatagagtgagactctgtctcaaaaaaaaaaaaaaaaaaaagaataagttaataaactaaacattcctgggaagactggccttaaattctcatcctaaatattagagttttaattttttcctacttttgaattattgaaacttcttttttactatcaagaagggctgactgtattttcctattgaaaacatatttgctaactctgcagtcatattcttttgttacagccctctcatttaaatttttcttgaattttgcctcttgttataaagggtggctttgtgttgatctttttcaggtttgtggttttctttcagagcaaagtaaggcagcttatttcttttgggcatttttgccccattttttaattgaagtacaattaatacacagtgaaatgtaaagatcttaactgtgcattttaagggaaacttcaagacatttgttcattgattcacaaaagtgcagaaatctcagcgatttttcaaaaaatgaactaacccatgtaaccggcactcagatcattcttggtaccccaaaagtccttttttgacacttcccatcacaatcccaccaaaggttaacctttatcaagacttttaacaggatagattagtttttttatatagaaataaaattacactctatataaatagtatatgctctcctgttttggcttctttcacttaacattaagtgaaattcattaagtgagattcatccatgccatggtggttatagtgttgttatagttcactcattctcaatgctgtacaatattctgagtcattaatgtaccatatttgttcattttgtgttgatggatattagggttgtatttttttttttctaatttggtcttgcagtctgtctctggaaagtagctataaactttattccccaacaggttccaagggatttggttgtggatgtttacaatgtgcctttcacaggatacttctttatcctggcagatggtatgatgcctaattgtctgaggtgtgaacaagtgtctttctcaccagaaattattttatactggcagatgcttgtggctattatcagacctgtgtcccgtttattcctgtcaagatagccactgtgtaggagaggcttaactgggagaaaagttaagtctgaatgtatcagtctggggagatataggtgtgtcagttgggtaatactatacagaggagacagcacaacaaaaacaggtgaaataatgtagacagtttattattcacaggttgatgggaaaacaggggtaccgacaggggctgttggaaatactgtagaggaaatgtgctcaaccagcaggtggagagataatgagttgaggcctttattgggtccagtatgttaccaaagcaggttacctctgatgagttctcattagtgggtgtagagcaagcaggcatgagttatactggatgaacgtctcgatggggaggttgtcaccgtggcatatctgcacagtccatgcatggtgtaagggatcaatgggccaagtcaattaggttatatctatgtgttccatagggaggtggtcatcaggaggcaattgtctaagatacatatctggagggaacacattaaggaattgggaggagacagagaactggaaactgtcaaggataatatggagcctggctcggtgtgagaaagttaaacttatattcagaacggataccgagacagcataaaattgtaagaattcactatgagtgttgtttccacttggggttactgcaaatataactgctatgagcattcttgtacctgtctttaggtgaacatatgtattcaattcttttgcagatatatctaggattgagattgctggatcaaggtgtatatgtatatttgggtttctaaaaagctttctttgggtaatttttttttacctattataaaatcactgatttgaagtgtgcaattcagtaatttttaccaactttaatgagtgttatacccatatgataaatctgtcatagaagatttttatgcccccaataagatccctcagctacatttacagttatatcctgtcttatcccagctccaagccaaagtaatcttcctatctttctatctccacaaatttgccttttctggacatttcataaaaatggaattatgatccatacctatgtggtatcttgtgttcaccttctttcacttagcataattttcagaaatcatccatgatatacccatgcatcaggaattcattcctttttattgccaaataatattctacagcttgtctttcccttcatgagttgctgagcatttgggttatttgtagttttgtctcatttgaataataaatcatcatgaatacttttgttcaagtctttgtatgaacatatatttttacttctcttgggtatgtacctgggaataaaatttctggcttgtatattaaatttatgtttagctttgtgagaaactgaaaaactgttccaaaatgactgcactattttacattcctgccagtaatgcatgaggagagggttcctgtttctacacatcctcaccaacgttcattattttctgtcttatatttattatagctatttacgagggtctgaaatgataatgtgttgtggttataatttgcatttcctttatgactaatggtcttggacatttttaatgtactcattagccagatatatatatcttcttttatgaaatgtctgttcatatcttttgtccactttttgattggactgtttattttctgttttttcttttcttttttttttatttttgagatagagttttgctcttgctgcccaggctggagtgcagtggtgtgatcttggctcactgcagcctccacctcccgggttcaagtgattctcctgcctcagcctcccaagtagctgagatcacaggcatgcaccaccagccctggctaagttttgtatttttagtagagacagggtttcaccatgttggccaggctagtcttgaattcttgacctcaagtgatctgcccgcctcagcctcccaaagtgctgggattacaggcgttagccaccgggcccagccatatcttcttactgtagacttctaaagattctttctaaattctggtttgaagttctttatcagataagtgttttccaaatattgtctcacagtctgtaactgaccttttcattttctctttctttctttttttaaaaatcaatatatatgttttcatttttttaaattttttttaaaattattaatttttgtgtgtacatagtaggtatatatatttatgagttacatgagatcttttcatacaggcatgcaatgcataataatcacatcatgggaaatagggtatccatcacctcaagcatttatcctttgtgttataaacagtccagttatattttttagttattttaaaatgtataattagattattactaactataatcaccctgttgtgctagcaaatactaagtctgttcattctttctaaccatatttttgtacctattaaccatctccactcccctgcttcttcccagactcttgtaaccatccttcaattctttttattttattttattattattatactttaagttttagggtacatgtgcacaatgtgcagtttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcagttcccacctatgagtgagaatatgcggtgtttggtttttttgttcttgcgatagtttactgagaatgatgatttccaatttcatacatgtccctacaaaggacatgaactcacattttttatggctgcatagtattccacggtgtatatgtgccacatttccttaatccagtctatcattgttggacatttgggttggttccaagtctttgctattgtgaataatgccgcaataaacatacgtgtgcatgtgtctttatagcagcataatttacagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcgtgtccttcgcccactttttgatagggttgtttgtttttttcttgtaaatttgtttgagttcattgtagattctggatattagccctttgtcagatgagtaggttgtgaaaattttctcccattttgtaggttgcctgttcgctctgatggtagtttcttttgctgtgcagaagctctttagtttaattagatcccatttgtcaattttgtcttttgttgccattgcttttggtgttttagacatgaagtccttgcccatgcctatgtcctgaacggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaacggggaatcctttccccattgcttgtttttgtgaggtttgtcaaagatcagatagttgtagatatgtggcgttatttctgagggctctgttctgttccattggtctatatctctgttttggtaccagtaccatgctgttttggttactgtagccttgtagtatagtttgaagtcatgtagcgtgatgcctccagctttgttcttttggcttaggattgacttggcaatgcgggctcttttttggttccatatgaactttaaagtagttttttccaattctgtgaagaaagtcattggtagcttgatggggatggcattaaatctataaattaccttgggcagtatggccattttcacaatattgattcttcctacccatgagcatggaatgttcttccatttctttgtatcctattttatttcattgagcagtggtttgtagttctccttgaagagttccttcacgtcccttgtaagttggattcctaggtattttattctctttgaagcaattgtgaatgggaattcactcatgatttggctctctgtttgtctgttattggtgtataagaatgcttgtgatttttgcaagaaggaatggtaccagttcctccttgtacctctggtagaatttggctgtgaatccatctggtcctgcactctttttggttggtaaactattgattattgccacaatttcagagcctgttattggtctattcagagagtcaacttcttcctggtttagtcttgggtgggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagtggtctatcaattttgttgatcctttcaaaaaaccagctcctggattcgttaattttttgaagggttttctgtgtctctatttccttcagttctgctctgattttagttatttcttgccttctgctagcttttgaatgtgtttgctcttgcttttctagttcttttaattgtgatgttaaggtgtcaattttagatctttcctgctttctcttgtgggcatttagtgctataaatttacctctacacagtgctttgaatgtgtcccagagattctggtatgttgtgtctttgttctcgttggtttcaaagaacatctttatttctgccttcatttcattatgtacccagtagtcattcaggagtaggttgttcagtttccacgtagttgagtggttttgagtgagttttttaatcctgagttctagtttgattgcaccgtggtctgagagacagtttgttataatttctgatcttttacatttgctgaggagagctttatttccaactatgtgttcaattttggaataagggtggtgtggtgctgaaaaaaatgtatattctgttgatttggggtggagagttctgtagatgtctattaggtccgtttggtgcagagctgagttcaattcctgggtatccttgttaacgttctgtctcgttgatctgtctaatgttgacagtggggtggcatccttctattctttatgtccatgatttcagttgttttgagttttagatctcataaataacttgagaacatatgatgtttgtctttttgtgcctggcttattttccttaacgtaatgatctccagttccatccaggttgcagctaatgacagaatctcattctgaatcatactccattgtgtataagtactacattttctttatccattcatctgttgatggatacttaagttgcttccaggatcttggctattgtgaacagtgctgcaacaaacatggatgggcagatatctcttcagtatacagatttcctttcttttgggtgtatatatatatatatacacacacacatatacacatatgtgtatatatacatatatacatgtgtatgcatatatatgtatacatgcatatatgtatgcatatatatgcatgcatgcgcgcatgtatacagatatgtatacatgtgtatatgtatacagatatacatatgtacatatatatacctgtacatacatatacacacatatacacacacacacacacatatatacacacatatatatccaacaatttgattgctggattatatggtaactcaattttgagattttttgtggaacctccaagttgttatctatggtggttgtactaatttacattcctaccaagagtgtacaaaggtttcctttttctccacatccttgccagcatttgttacttcctgtcttttacataaaagccattttaatgagataagatgatatctccttgtagttttgatttgcgtttatatgatgatcagtgacattaagcaccttttcatatacccatttgtcttcttttgagaaatgtctgttcattattagactttttttctacacagtagtttgagctccttatataccctgactattaatcccttgtcaaatgcatagtttgcagatattttctcccattctgtaggttgtctctttgctttgttgattgtttcctttgctgtgcagaagctttttaactttatgtgatcccatttgtccatttttgctttggttgcctgtgcttgtggaatgttactcaagaaatatttgcccagtccagtgtcctggagaatgtccccaatgttttcttttagtagttttatagtttgaggtcttagatttaagtctgtaatacattttaatttgatttaggcaagagatagggttctagtttcattcttctgcatatggatatccagttttcctagcaccatttgttggagagactgtcctttccccaatgtatgttcttgaaacctttatcaataatgagttcactgtagatgtatggatttgtttccaggttctcaattctgttccactgacctgtgtgtccgtttttacaccagcaccttgctattttggttactatagctgtgtagtataatttgaagtcaggtatatgattcttccagttttgttcttttagattaggtcttttttctgttcattttctcatttagttcttctttatttttaatttttttgagatggagttttgcttttgttgcccaggctggagtgcagtggtgcaattttggctcactgcaacctctgcctcccaggttcaagcgattcttctgcctcagcctcccgagttgctgggattacaggcgcccgccaccacgcccagctaatttctgtatttttattagagatggggtttcaccatgttggccaagatggtcttgaactcctgacctcaggttatccacccgcctcagcctcccaaagtgctgggattacaggcgtgagccaccgtgcctggccaatggcttatttttaggtgtgaaagttttgaattttgacaagacataatttattatttctttctagtattcactacacccttggtttcatatctaatgaatctttgcctaacccaacatctgaaagatttttaccaatatgttttcttgtaaaaatttaaatcttctaaccccttcatgtaggtgtttgatgcattttgagttaatgtgtgtatatggcatgcattgtggatctaaatgcatctttttgcagttgttcatgtgattatataaaacacaattcctcgagtaggcttcccttctccagtgaattgctttggcacctttgctagaattcaatgaacttataaatgtagtttttgaattttatcatactgatttatatgtctttccttatgcctggtttacaccatcttcataactaactctatataggcatacttcactttagtacacttagctttattctggcatacctcatttcatggcattttgcagatattgtgtttttaaacaattatttatataaattgaagcactgtggcgatgtactgagcaagtttcttggtgccattttttcaacagcatgtgcccacttcttatctctatgtcacatttttgtaaatcttggaatatttcaaactttacaatttttattatatctgttatggtgatctgtgatcattgatctttgatgttactattgtaattgctttagggtgccacaaaccacgctatataagatggtaaacttaatctgtaaatgttgtgctgtgctctgccaatcagtagttccttatctctgtgcctctccttgggcctccctgttccctgagacagcaatattgcagttatggcaacgaataactctaccatcatctcttagggtccaagtgagtcacacatctctcactttaaatgaaatgctaaaaatgattaagcttaatgaggaaggcatgtcgaaagctgagataggccaaaaactaagtctcttgtgcaaaatagtcaagttgtgaatgcaaatgagaaatccttgtaggaactgttttttgctaaaaagttaaaagtgctactccagtgaagacacaaatgataagaaagaacaacagccttatagttgacatggggaaagtttgagtggtctggatagaaggtcaaaccaaccacaacattcccttaaaccaaagtttaataaagagcagtactctaactcttcaattctttgaagcttcagaatggtgaggaagcctcagaagaaaaatttgaagctagcataggttgttggttcatgaagtttaaggaaagaagctgtctctataacataaaagggcaaagtgaagcagcaagtgctaatgtagatgcatgttgtctagaaggtgtagttagaaggtgtagctaagatcattgacaaaggcggctacagtaaaatacaacttttctatgtagatgaaacagctttctagtgaaagtcctatgtaggacttccatagctagagaggaggagaagtcaatgcctggcttcaaagggcagactgactcttttgttagtggctaatgcaacttgtgatgtaaagttaaagccagtgctcattgaccattctgcaaatcctagaccccttaggaattatgctaaagccactctgcctgtgctctataaatggaacagcaatgtctggatgaaaacacatctgtttacagcacgatttactgaatattttaagcccactcttgaaacctctgctactcagaaaaaaagattcctatcaaaacattactgctcatatgcaatgcacctagtcacccaagagctctgatggagatatataaggagattaacgttgttttcctgcctcctaaaacaacatccattctgtgtagctcatggatcaaagagtaattttgcctttaagtcttattaagaaatacattttgtaaggccatagctgccataaacagtgattcctctaatggatatgggcagagtatattgaaaacctggaaagggttcaccattgtagatgccattaagaacatttgtgattcatgggaacatgagcagttcaatgaattctattacactatgagtgcttttggctagattatctagctttttgaccttggacacattatttaatgtagagcctgatctccatctataaaatgggaatcacagtagtacccacctcatatgaccgttgtgaggattagatgacattttatatggaaaatgtctgcagtaaaccgtccataaatggaaggagttttttaaaaaatgttgttggtataatcaccattatgatctttatgattctatgttttaatttcattttataatttatcctgtgattttttttacctcagcatcaccctttataggatataaccacatttcttctcaatacctataccaacagcactaatcattaaagaaatgcaagccaaaaccacaatgagatacacgtcacacttatttgaatggctgttattaaatagacaaaagataacaagtgtttttgagagtgtggagaaacaggaaaccttctatacagttggtaggaaggtagattagtacagccactgtggaaaatagtatgaacatttctaaagaaattaaaaatagaatgaccatatgactcagcaatccctcttctggttatatacccaaaggaaatgaaatcagcacctcataatcatgtctgcattccgtttttgttgcattgttattcacattagtcaatatatggaaataaccagtgtctgttgacaaatgaatggataaattgtggtatatatacacacacacacacacacacacacacacacagaatggattttcattcagccttaaaaaagaaagagatgtgccatttgcgacaacatggatgaacatcataatgatattagcccaaaagagaaagaaaaatactgcatgatctcatttatatgtggaatttaaacaacaaaaaaaaattcagtggtttttgtgtaaattagtacaatagaagatccaaggtagagtactttaaattagcaagatatttctaactgtgcattttaagaaccatttttatttttcttcagtttggaactacaacctttagatatcaaaatgccctttgtaacttaatttttattcttttttatgagagaggtgcatgtttttcaagtacatttatctgttaacaaaaatagttggagttcgcgaaagcctattatttaggcaaagtcttcctttgcaaagattcagactaaagtactagcaggttttaaataatacatgatttattatattttcttgtttttgaactgagacataaaatatcctttaacttaaaaatatgttttattatttaataataaaagaagttgtttcttcaagctaaatgcctggtaaatacattttattatgtgatcagcttgtccgtattctaaaataatagtttatgacttacatgagcctattttttcacttgattaagtaacataattagctgatttacaatataaaacatattcctaaaacccttttcagctttgaaatttcaaatgccactgtttccatataatgacatgtgaatttacattttagaaagcataatttaaaattatatacctctatatttttaaggttcttggcaatttaagtagaataatttccatagagagacaattcttccctcctactctgtatgtactctaatgttgtctacttctttcttctgttcctgcagtgttacttacgttttttatactatccagaggcttaggctgtttgcctttgatgacatggatatatattgctcagtcatacgctttcaaaaaataatctcttcatttagtttttttattattttattactattaatttataataaaatttggtttatatgaaggatcttaaataacatatataaggtataatcaataatataatgagtctataagaactcagcataaaaaacagaacattttcaatagcttgaaagcctcctgcataccccttcacataaccctcccagatcatattgctttcctgttctgatacagataaccagtatctggaatttagtatttaacattcctttacttgtttttctttttataggtttactatatgttttagtttgtgctaagtgaaatggccactactcaaccatttttggtctataattataggaattttatatggttcagctgagtacacacatacacatgcacactcccaaacacactggcctgttgttgaacattatataagtgatgttacagtgtagtattcccactactttctttttttactcaacattatcacctagagattcattcatgttgctgtgcaaagctctatttaataaatttgtgctgccatatagtattccgttatatgaatattccccaattactttataaattttcttgtttatggacgtttattgctgctttcaggtttttggtgttttgacttttataagtaatgctgccatacttcttttttcacatatcccaacaagtgtctctaggtaggtatataaagtagtgaaattgcagagacctagggcatatacatattcaatttttataaacaatactaattttccaaagtaattgaccaaaagtatacttttaccatcagtgtaaagattgttcctttgtactaaatctttatcatttttttattttctgttttttaatatttgctcctctggtggatattatgtggtatttaattgacctttgactttgcatggtatctaattgaggttctaattaaggttctaattattaatgaagtaatgaagtggaatatttttaaatacatttattatccattcatttttcctccattttgaatgacctgctcatgtcgtattctggttttggtattagggtaatatcggcttcatagaatgaattgggaagtgttctttcctttcaattgttggaagtttgtgaaggattcatattaattcttgaagtttttggtagacttcaccaaattaataatttttaattagtaatttaatctctttactcattgcaggcctattcagattttctatatctttttgagtctattttcttagctggcatctttttaggaatttgtccatattatctaggttatctaattgagtgtcatacagttggtatatctttttgatcttctgtaaggttggtagtaatgttctctttttcgttcctgattttactaatttgagtcttctcttttttttctcccggtcactgtagccaaagatttgtcaattttgttgaactgtcatatgtttttcatatttcgttaattatgtttattttttgattctctatttcattaattttattatttcctttattcttcttgctgttaggtttactttgctattttcccagggccttaaggtaagaagttaggtgattgatttgagatatttcttcttttgtaatataggcatttacagctttaaatttccctgaaacacactgcttttacctgtatcacagaagtattggtatgttttcatctctattcatctgaaaatattttctaattttcattgtaatattatttgatgtgttggttttttaggagtatattgtttaatgttcacatttgtgaattttcaaaatttctttgttattgatttctaatttattccatgtgctcagagaacatactttgtattattcctgtcctttaaaattattaatgcttgttttatgacctggcttatggtatattctggaatatgttcaatgtgtatttgaggagaatgtgtgttctgctttttttgaatggcatgttctatagataatctgttatgtatacttagtttataggcctattaatgtcttctatttcctattcatcttctgcctagttgttctattcatcatttaaagtggggtattgaagtgtgcaactattattgtggaattatttatttttcccttcaattctgtcagttttgctttaatgtactttggtactctgttgttagttgtatgtgtgtttatactttatatgtcttctggatggattgaccttattattattattaaatattcctctttgtttctactaatattttttggtttgaagtccatttttttctatattggcattgccactccagctttcttatgcttgctatttgtataatatatgtctcccttttacatttaacataattatatgtttaaatctaacatgtgtttgctatagaaagcatacaactggatcttgtttttttttttaattttccagtctgaaaatatgtgccttttgattaatttgtataatcaattaatagttaatgtcattattggcatgggtgcacttatgtctgtctctttgttttctatatgcataatcttttctgttcctctgttcctctcactggtttcgtttgtattaaatggaaattttttgttgtaacattttaatcctttaatggtattttcttattttactcgttttcttaattgttgctctaggacttaacaatttatgtgagaacttaccagaatttctttcagatgttaaattttcctgagctgtagctatttcttctcccttttttggtgctgttattacacatatgacgtctaaatacgttatgtaactccaacaatacattattacaatgattacttttgatagtttttttgtcttttactgaacctgagagaggaatggagagcaagtatataattttaaaaacttgttgattaaacttctcatttactatttctaatgttcttcatttcttggtatcatacccagctgttatccctgagtaattgttgaccgattgctacattgactttgacagtttcctgggacataatctgctccacagtgatacatttatttttggacccctttgcaggaatagtctttgaggccagtgtttcatgcttgctccagccataggtgggcttttctcagctatgtgtttgtttctcacttgtaaactggctggcctatgatttaaagagctcattaaactactaacctcctcataattgcttaccacaaaaatctacactgttttcagggactcccttaggctcaaacttccttacactctgttttaaataaaaatcagttcccttctagagagccttggacctgttttttaatagcctgcctctccccgtgggcagaacatatgcactaaagctttgggaggtaggggtggggacagtgtcatccttctctcagaatggcatccatgctctaggaagaggacattgggtaaaaacagtaacccgtggtcttcttggcttccccctccctgcatggaacctctgccttgtgaattagctggagcagggctgattggggcctagtattctcagattacttttcctagggtagagcttccgtcctgtgactggtcacttgattgaggaaaggagctccagacctctataacatgattgcctccatagagcttttgtaacctagagctgagggtaggatgaaaaattccaatcacctgctagagggaaaagtgcatgcccttggtttttggctgccccagccataagcaaaactttatcctgctaagccatccaggggaagggggagggagcaggttgtggctcagatgccacagactcttgctcttcttactgagatttcatagattttactaaaaatgtttctccatttgccgtataccatcaggacagattctagagactctaaatggttatttttcaaacaaataattttccccagttgtggttgttttgctgggagctcctcatgttgccattgcacatgtatctcttctaacgtggagaaacatttgacatacaaaaagtatactgtaataataacagtctaaccaaactttccagacaacagcaggattttcctccaacatctgtgtttgatacacagttgcttatattttgtttgtactcttgtatatgtcactgccctgcagccacagtacctacctgtgtttgaaaacaggtccagcctatacctgcctttggcctttgcactagctagtttctctttctacactgcttttgcgcaaggctctttctccattttcttcagatctcaacataaacttcaccttattgcagaaactttcccatatcactggatagaaaatagcacctctttggcaggcacctgtagtcccagtcccagctacttgggaggctgaggcaggagaatggcgtgaacccgggaggtggagcttgcagtgagcccagattgtgccgctgcactccagcctgggcaacagagcgagactccgtctcaaagaaaaaaaagaaaaaaaagaaaagaaaatagcacctctttatctctcttgatccctcatatttcattttaccaatacttaatgtattttgtcatatattttaattatttgtttatcctttctttgccatcgttagtacttaagctccataggggtatgaattttgtctgttttgtgttttgtggtatgcctagtatgtagatcagtgccatgcacaaagtagactttttattttattttattttgttatttatttaaatttccagttttattttagatacagggggtgcgtgggcaggtttgttacatgcatatgttacacccaggtagtgagcatagtatctgtagctagtttttcaacccacgccctcctctttcttcccccgtctaatagtcttcagtgtctattgggcccatgtttatgtccaggtgtgctcaatgttttgcttccacttataaatgagaacatgtggtgtttggttttctgttcccgcattagttcgcttaaaattatggcctccagctgcatccatgttgctgcaaaggacatgattttgttctttttatggctgcatagtattccatggtgtatatgtactacagtttctttatccaacatactattggatggtatacttttaataaatatttttagagtgaataaatgagttacagtatggcaattttatctatccccagaggagcactgtccaatacaactttctattatgatggaaatgttctctgtctgagttatccaatgtggtagatgctagttacatgtggtcactgaggatttgaaagatagctagtgcaactgaggaaatatattttaaattttatttaatataaattcagattaaattaggccaagtgtgcatatggttactttacagcacaactccaaaaagtcgtccgccttaccatggcatcttttcaaggcataatttttaccttttattcctattcatggagttacttctagcattgctggtattgtcatcatttttactacatactatgtgcactgtaagcatcttgggtctttatagaaactccctttggttatacttgctgtcaataaacaagagttcaattatcgggatttgtctacaaatgaaattacatccttaattttgcttgattttggaaataagcatctagttgtctcttcatttcttctttcatatgtgatacattttgtaaattttttcaagtcatattgtttttgcaataaaatggcatgaagtactgatgcataacaacatgaatgaaccttgaaaacattatactaaatggaagaaggcagtgataggagatcaaatgttgtttgagtgcatttatatgaaatttccataataggccaatctacagagaaagaaagtcgattagtggttgcccaggctggtggggaataggggaaatggggactcactgctgaagggtttgggctttctttctgcatgatgaaaatgttctataattagttatggttatagttgtacaatttgtgaatatactaaaagcctctgaatttcatatttcagtatgtttgtgtgtgtatgcatgtcttatatttttatatttattttatcttttttctttttttatcttttttttttcaaattacccagaatctgagatgtgtttttttttttttacctcttccttcagagattctgattcatcagaactaagatgataatctgcattttaaacaagcaatccaagtgattctgatttaggttgccaaaagatttttttctttaagaaacaatgctttaggcaaggatgttattaatctttctttaagaaatttctgataaagtagggaaatgcatatctttcccctaattatatatgaatatcctggcctccctgataccatggttatattttgaactgaaatttgtagttattgatgatgctgacacattttctctgtatttggcatgccattgctattttagacatataaggacactcaattgctgtatggtactcagatggctttatcttatcagttgaaatttcttcttattctttgtatttttctttaaaaaatagatttggtacttgccataccataacctctgttattacaactgttttaccattactttgaaacctattgtagagaaacaagaactctttctctacattatcccagtcttcacattttgtaagctgcttatcaggttgggttttctagtaagatatcagaagcacagcctacacagggcagagtatgtccaacatgtggtggtgggcaatctgtgtcttaatcatctggaatgtttgttaaatatcctgggatctgagaatcaaaatttctgaagaggtagtgtattagtctgtttttacactgctgtaaagatactacccgagactgggtaatttgtaaagaaaaaggtttaattgactcacagatccacatggctagggtggcctcaggaaattcacagtcatggcggaaggcaaaggggaagcaaggaccttcttcacatggtggcaggagagcagcatgggggaaactgccccctgatccaatcacctcccaccaggtctgtctctagacatgtggggagtatggggattacaattcaagatgagatttgggtggggacacaaaggctaatcatatcaggtagcttgagtatacaggttactatcatgtccactgaagtctgagagcaactgacgtaaatttttcattttcctttttttgtgtgccaaaactgtagatgagagaaccactgatttatgtagtgatctgtgcctttatgttctctaatacacaacttcagaacagttttaaaattcattctgattcttccttaacttggtcattatatttgcttttcttgggatgggtagaattttgcagtttcacttgaaactgatttttgcctctctacttgatcttgcttgtctaataaaaactgtgctttgcaccctctagcatgctttttgtcacctggctctactcccgatttctacactacttaacttggtcagcatagacttcacctttaatagacttaaaaaaaatctctgctactccgtttatgtgtgtgtgtgtgtgtgtgtgtgtgtgtgtgtggtgtgtactattgttctgctaatgttcttttatgctttggtccttcttataaatccataaaaccatagggataacagtattacaattttaaatacctgtaacctctgacctttcacagaaaatatgaaatacatagacgtattgacctgaccatttctaaattgctatggcttctaaccttttccagcaatctgaaaagttgtgggaatttatattctatttgtaaagaaaggactaagaactgtgacttcaaaataagaatcatagtagaccagttataaaatgcactatctaaaaaggtatgcttcacatttatgatcccggtatttgcattctgtgtcaaacattaaatatgagagaattattccaagagagatgaggaagaatcgatataattttagctggcagaatttattaacatatttgcttatcagtcctcacaaattatgagctgtccttaggtgatatatttatttggattctgctgtgttgttttggtggcaacaccatgcctgaataggtgaaaggggctctggaatctagatacttgccttaaaaccttgtccctgccatctgctagttatgctgctagtctagttggctctcctgtctgagcctctctttctccacaggtgaaaggggaaaataatagtgcccatgtcatagagttatagtgaggaacatctgaaataattcacagaaagcacttagtgcaatgtttggcatatggtaagcactctgtaaatattagctgctattattttcatgattgttaataaaattgctgccaatgttgttctttgtctacagcagtgtttcttaacctttttagacataaggtccttctcttataacgaacatttggtaactcctcctttaatattatggaatgaaaatcaaagatctataacctgtatacatataattttgaaaaatgttaatattattctttaatggtaatagaaacaaaatagtagtccagggctacagtgtatgaccactatatcataaatccccaagacctgtctcaggttcataaatttactagaaggaatcacggggtctcagcatatacttgtattagtggctgagggttattataatggcataagtgagaacatatagccaaatcataagggaaaaagacacaggtggcatgtgcaggaatccttgtgcaagcttccttacgctctctcccttcaacaaggggtcacacaaagcacattcttaccccagtaacaaaaagaaagcaacacatgcaatgtttctgtctagggaaggccattagacactcaatgttcagggttttccttgggggctggtcacactctctgcctcatacttaccacaattacagataaaagaaggtattcagtcatattatttgaagtgcttgagagggtatctggtggtctaactgcttcttctacagaatttcagtcatttctcctattttcagctctaccaaaactcaccacttacataagtaatcctgattggtatggctttctgaggtttggtgccacaagacagcttatttactattggtgtcaaaatatttaagttggtttgagatttttctggtacaacaagctattaataatttgcccatttgctttctttctttcttttttcttttttttttttttttgacatggagtctcgctctgtcacccaggctggagtgcagtggcgtgatctcggctcactgcaacctccgcctcccgggttcaagtgattttcctgcctcagcctctcaaatagctgggactacaggtacccgccaccacacccagctggtttttgtatttttagtagagatggggtttcaccatgttggccagtctggtcttgaattcctgacctcacgtgatccacctgccttggcctcccaaagtgctgggattacagatgtgagcctccacagccggcctgtgtatttactttctaatttacaacattctgttaacagctattgtctgccctatagcctcccctactctctatacatgtacattcttcaataagtcaacatgagcatgtttacttgctgaccgtaaggagctagcagattagaagtggatggagatattaagagggaatcaatagggtaaggtcaggccaagtggggtggctaacacctgtaatcccagcactttgggaggccaagacaggtggatcacttgagtccaggagttccataccagcctggacaacatagtgagaccttgtgtctacaaataatacaaaaattagctgggcatggtggcatgtgcctgtggtccagctacttgggagtctgaggtgggaggatcacctgagcctggggaggtcgaggctgcagtgggctgtgattttgccactgcactccagtctcggggctacactctgtctcaaaaaaaaaaaagaataaaaaaataggataaggttctgaggacaatgaagaaagggtctgagatgtggagcacttattgagagatgagcctttgataggaggatggcctcctctttcattgtaacaggaggttaagaggagaggttttagtaaacacaagaaactttgtcaatttgggaaagaaaagagaaggacgtgtttgtatggtggtttctgccttctctatgaagtgtatggtaaggctacctgctgagaggggtgatatggtttggatgtttgttgccacctagatctcatgttgaattgtaatctacaatgttggaggtggggcctcatgggaggtgattggatcatggagatggtttctcatgagtgggttagcatcatcccctcagtgccattcttgtgatagtgagtgagtaagtcctcgcaagatctggttgtttttaaagtgtgtagcaccccctgaccccacccctgtttcttctgctctggccatgtagacacgcctgcttccccttcaccttccaccatgattataagtttcctgaggcctccccagaagcagatgctgccatgctttctgtacagcctgtggaaccctgagccaattaaacctcttttctttataaattacctagtctgaggtagttctttatagcagttcgagagcagactaatacaaggaagtaaagatgtgagggatttcaggtcttgggaaattggaggaagtttgaaataaccgtttcaagggagggaaggagtacattgacctgagaacacagacttgctagaaggtgttaaatgcccaggggagattgttgattgtgagtatatggtgacaccagtcttacctgttgtgtgacttttttagcagcatctagctgcccctgtgcaggacttgtcaatgctgggttcacctcatccaggggtggactaaaaactgttgataaaatcataacaggttgaatgttactgcctatgaagtttaaggtctttccttgctcagcatcattttattttcatgatggtttgttggaggatgggtctcgatatgtctttcagcctcaattgactcatacctactaagactggaaaggcatgctctccagccagctgacctcttgaatatacgatgacaaactattatctgctgcctgtttttgtaaaataaaagttttactgaaacatagccacacccattcttttacttgttgtctatggctgcttttctcctacaatggtagaggtaaataattgtgataaaaactatatggcgggcaaaatctaaagtgtatatgtggccctttacagaaaaagtttgccaacctctggcctctaggcagctgtctgaatcctgaagccactgttacactgtgtgctgtttactgacattttttcccttaggtggtgtcatagtcctgcatttttggcttcttaatctagttccttacttaaatatgattcaagtactttcttttcttccactaaataaattttacatacacacagagagatagagagacatgtatatttcaataagttctgccaatgtgaattaataaataagaagtgttataataataatggacatagaattccaatttcagactcattttttaatcacaaaattctattactgacaaatatgtaggtactcttccgtacaaatttttctgagttacttaatttctcctggcctcacctctttgggaggtaatttagatgaaatggcttaaaaaagttatagtttcacaactattcctcaaagtcctagaatctttttactttgctgactctacttgcttaattatatttgctaatccatttcattagtcaacacttggcaagcccaagtgtactcatctgtctattaccttttcatctactttagtcttaagtaaacaaatgccagttcatgttctcagatactcagatgtaggtttaattgttaatatcttattcattattgtacaagcttttgctgttgaattttaatattaaaataatgataggttagatttgtgctcacaacttattattatgttccattttttcccactcaaccgtacattatgtaccctttcttcaagattactgtacagaatgattcttacatatttcagtgtgacattctttttttattgaggtggaattcatatattaactattttcaagtaaaagttcagtggcatatcatacccttacagtgttgtgcagctgccacctctatctaatgctaaaacttttccctcaccctaaaaggaaactccatttctcttaagcatttgctcctcattcctgtttttctcctactctggtaaccacccgtcttatttctttttttgtaaatttccctgttctggatatctcacccatatctagatgattctgtgtggtgtgtaatatgtgatattttatgttaggcctctttcactgagcataatgtttatgagttttgtccatattgtagcatgttcagtttttcatgctttgtcatagttaataatattcccttgtttatatataccatgttttgtttatccattaatccattgatgaacatttgagctgtttccgccttttagttcttgtgaatagtgctggtatgaacatcaatgtccatgtacttgtttgagtgtctgttttaaattttttttttttggtatataactaggagtagaattacaggatcatatgacaatttcatatttaagttttcgaggaaccatgaaactgtttttcatagcagctgaaccattctacattcccaacagcaatgtatgaggatcccagtttttccatatcctcaccagcacttctaattttctagtgttttgattatagccatccttgtgtgtgtaaagcagtatctatttgtggttttgatttgcatttccctacagattaatgtcaagcatctcttcatgtgcttttggccatttgtatatcttctttgctgatatgttcttgttcatcttatttttccttcacaactggagaagacagggtatatataaatgatactaattatgagaaaaatcatagtcatggaaaatcttgagacttcaggtcagtagcttcatatctaccatggaggttaatttaatgcttgttagctaaaactttggtaaaacttctcataaattggtttgcttcatattcattagagccttccactcaaagatgtgataattgttattttgactatttgcaagggatttggaaaggtcagtgtatgtggtgatttttcatttggttggttgaattatgaaagctgcaggagcaaggagtcatttattggaatgagtcttgcagagtccttaaaatacatatctcagatatggctttgttattcttcataatgacatttctgaatttgggaattctgacaaagtatctgcaggaccacattatggctttcatgggcaataggtacttttgttttgtgggccatgaaaaattttgctacataaaagatattaaaatatctttcagaaatactaaaaatttccatgaaaatattataattctattttctgtctacattgctatagagatgaatattttacaggctgtcttgtattcatattttcttctgattttaaaagaaattaaaacattacagaacctctaacagtatcctgggcccaaggcattatgcttgctttgtgcagtgggatgtgggccctggatatctgaagatatctatcatgattttgtttagccctttgtgatttttattatcattgatgtgtgagttcttaacagttactgtgattacttcctaataataatgtgctctttacggctactttgaaatgtccatttcatataactcagatcataataaacttgccctttttcctcattttcattatgggctcagccgtctcagcttgttcaattttatttgcattttcctcctcatattctgcttgttaccatttgagctctcagctgctggaaagcccttcccagagcaggtctttggggataacaggtttcactaaattggtttcagaaggtgaagtttagtgttcatttggtctccactggcagccctgaggagatatgataacacaggctggaaaagaaaaattccaatttcataaagagcattctgtacagtgttggcataaacaaccctgatactagcaaggagaacagactagctttgggatagtatacaagtttattgctaactcttcttttttatggtgttatcatattatcgtatcctttaacatcctttgtggtttttttcttgttccatgttcacttttccaaatctcattgcctgtcatcatcttccttccatcactggcattttttattaatgatctgctttctcctttcccataagccagtcttagtgtcttctagcaatgtcatttaaaatcccacttcctcattcaagccacagtccatagcactaagcctttcttcttcctttctcataactggaaataacagatctctcaggaaaccttcatttcccttactgagagatggtgctcaagtcaaaagcataggagctcacatagaaagcaaattctttagagatccttgattacaggaaaacaggccacaggtcatgttaaaccattaatttttggagctagccatgaagcttaatcaaattgatgttaaaacgattcttttaaggcattgactatccacgcattgattcttaggctctatttcatcatcataacttcctttacatttttatgataacaggaatagcaacattattatcatcattcatagtaacaaatgtttatatagtgtttagtgagtaccaaagtctaagctttttgcatttatgaacttatttaattctcataactcttataaactgggtgctattttttacctcatgtcattgaaatcaaataatttgccctaagtcactcagcaagtaagtggggatttatcatctcctgttcatcttgtaagctgttttctatttcaggaagcttaagaaatctcagttttattctgtgaaggctaattcatattattagcacatcaggaaaacctgttacaaacaaatattcagcagagacatagaaatcaagaactgtgttcctcatatcaagtgtatgatcaaggcaaactgggaactgcttttatatgactctctcccaatcacactgaattctatgattccttatcccatttccttcactaaggttatccttggggttgattcctgccaacttggggatctccttgaatgacatcctttctaattcctactgttagagtagatctagttagggaggacatttatgaagaaagacctctcccacaacaccttgaaaccgttgtagcttacttatcctgagtggacaggcatgggcttggagggtgaaggggtcttgcagttctaacatgttactcatgttctttcagtcatcttcttaaatatactttgtagaactatgaggccttatggagatcttaggagaagtactaatgaacatagaatttctgtttttaatcatacagtattccaattttcagttgccatatgtacatatatgtacacagacttgtgtgtggatgcatgcctgcttgtgaacatgtttgcctttgtgtacacacacagacacacgcctttgtgtacacacacagacacacacaaacacacacacctgcaaagatagtttgaggtaaccataatctttctgtggtaagcatctgaggtctttgtaaagaggagtgtactttccatttatggcatggcaaatacattaatcccaagaactctcaatatcaaggcccttttatggaaagtttcaagaagctttcctaggcccctctgctgacctaattatcggggtaatctgttttatcaccgtcaggtggagccaggatacttttaaatttgggataagggtcagatgtattaatccatatcccagagtatacaaattaactcttggccagctttatataaaataaagtacaaagtcaggttctcagataaggttggtatgttgtttggtctttctttttattctattcctgataaagattcacttgttgtaatccagttatctcactaattaactaatatttatattattaacacaacaaaaggaaaactggtggatatcacaggcctccacaggacaggcaagtgaatgaatcacttaagctggttaaggactgtagtgatctgtagagcatatactctgcctaaagagggcagccatgtcttaaaaatttccacacactagccttactagaatgtggactttatgctgccagagcttctgatttttcaagaaacgtttggaatccagatatttgtatgaaaactaatttttcaatgctagcagttaattctaatttttaaaatacgatgccatataatgaataaactattataggagttgacaatttttttctgtaaagggtcagttagtaaatagtttggactttgaggtctgtatggtctctgtttcaagttctcagttctgcagttgtaatatggaagcagctgtagacaataagctaatgaaaatggtgtgttccagtaatatttacaaaaacaggtaaaggcctattttggcccagtggtggtaagtttgccaacctctgaactaaaataagatgtatcaaacatgtgtaagtatcgaaacataatttgactaaacaaagtgagctgtagaaggattcaaacattttattaccatttggattaaatgtaaaaacctgctaaaaaatgcatttatgggtatgtgcatgtatttgaatgataaagattgaatttatgatagtggttgtctctggagagggaaggatgtgggtccagagaggaattgattacagtatttaatttctttataaaaaggatctgatggaaatacagcatgatattaaaatatgattagtacatgggtgtttgcttccccccacctttttgtctttatatttgaaatactttacgaataaaaaacattagtatgcaaggcaatcaaaacatgtctgcagacttaatttgactcagatgccatcattttgaacaacctctgctgttcatgcgtgcaagcattctaaggatatcagctttgtagaaaatgatgagtctttatgtcaacaagttggaatctactacccatatatttggaggttttcaatgcaataacagtttgtgataggtgatatgaatgataaccaagatgtaagctggttttcatcaacctatatcatttcttttatttctgtttacaaaatcaggcataacttcttgacaatgtacatatattataattactttttaatgaccttgttatctagcattcctcatagtatctttctgttccctctgaggtttctcagagttttatacagtgtcagcttgttcttattagatctaattatttcataatccaatttaccatttctactcatcatcgaagactttcctcagtactgtcctagaaaacctgcaaagcattgtacatttctaataatatgatcttccacaattattgtttttcctgtgccaagatcaaggatggcatacttttctgttgatctcaaactcatttagttacgagtcatgaaatgatccatatattgagctttattgaagggcagaggttttgttttgtttacttctgtatccttagcaccttgaaacagggcttggcacagaatagctactcaataaatttgtgttgagttaataaataaatgaatgccattattcttttcagaggatataattttacatggtttctggtggaatgtggtgttattccaaaggcagctttagacattgcagtggcagaaggaaactttcagaattctgagtttatgatttattaacttggagtttcaccctgtgttccctaagtttttacttcttacattaatataatttgatttctaagttcctgatgttttctttttactttttttcataaacgttaatgtctaaattccaactatggttccttttctcaactgaaacttatttgtgtgactatgcaaaccttctttatacttaatgcttattatctgtgctattgttttttcagtgttgttcttagtccttcactttctatcactgctaccctttatggtacaacatggcctagtcagttgagttaccaaaagattaaaaaggaaatcgtggtcgataatcccagcactcggggaggctaacgtgagaggattgcttgagcccaggagtttgagaccagactgggcaacatggcaaaacccggtctctaccaaaaaaataaaaaaattaaaaaaaataaccaggtgtggtggcattctcctgtacttgggaggctcccagctatttgggaggctgaggtgggaggattgcttaagcacaggaggtcaaggcttcagtgagctgtgatcatgccactgctctccaaactggttgacagaatgagaccccatctcaaaaaaagaaaagaaaagaaaattgtagctcttcctgaacaagtcctgaaatgtctttcccatatgcattgaggatcttcaagataacctcccagtttggtaatttgttaaaaggactcataggactcagcatatattgttactcagggctgtgatttattacagtcaaaggatacaacacaaaattagcaacgggaaaaggcacatagagcgatgttcagaggaaaccagacacaagcttccaggagttctctagtggagtcactcaggatgtacaaaattcctccagtattgcttgtgacagcacatatgaagtgttgtctaccgggggatattattaaattattaattggcacaggtttattgggggctagttatgaaggcaacctctgtccagcacatatgaaaatgctagacccccagaaggaatgcaggtattcagcataaaccacattgtacaggcattctaggcatagtgagtcatgttgtcagttctagtagtcactgtctcctcacttagccccattaacagctgtggatgggcctttgtcatcaccaaggtacccgtttcccaaagatgaagaaatttgatttcattttgttgtctcttggtgtcaaaaacataaaaacatttttcctctcctggacatcttcaactctaatgcctttaccaccaagcatagtttcaaacttctagggagcttctctctgtaactaattggaaaatttcttttctgacctcctaaccctgtatggaggttgttggttttatatttagtaaattattaaacagcaacatgttttttaaaacatttgtactgaggcctgacattgggtagtttctccctgcagtcaggttacttgtcagagatggggcatgactccaaagagaattaatgtatgtttttgttatctgaagtgcccttgggggttccagaatcctcctgaagagcccatgtttctttagcaaaagaggtttttcaagtctgaatccaggatacaggaactcaaatgaaaagcttgttctataggagtcttaaaatagaagataagaggctacaaataatgaaatcaaatttgtagaaactgagaaatttcaatcagatgtaacaaaaagatccttgctggagaatatataccagtagtagtacctaactctcatccaagttttttaagctatgtaatttccatttgaccacttattctttatagattgaatttgatcgtagattataatttaaataaaataaagcatagccacaattcgagtgctgactgcaacctatcctagcaaacctttcacacacataccatgtctgagatattctcaatattgttgcaaataatccctaatcacctgtgtcaacatcccagaggttaagtcaaacaaaagcagagaatagggaaatgtataacataatagattttatttgaggagtcctatttagagtgattgccagatccatatttttcacataatttcattccttaataactggtacttcgtcacaaattatcaagcagacgttgataagttatctgaagatttgatttcataagcttccacaataatgatgctgtttactaacagaatatccatcctatcccaacataaagcccgctgggaaaaaagtcattctttttaactagtaattacatgcttgtccctatctcactatacagtaatattttatttttagtctgtctccactacactgtatgttctttaagactttgaattattctttgtcttttacatttatataacacctatgtgagcatgctcgtaattttccagggtcatacagactgaaatattgctgcttttgtcctttgttaattccatctaaaacatggactaggcactcttaggtttcagtcatctgagtagatgtttaatcaacattcgagaaactatgtgggagaattaacggcaggtgatgatggtgggacttgaagcctgtttgccaggggccccggttgtgaacatcattttcagtactgtccagacacaggggcaactccctgtcatttgtgactctttccgtcttggctcttgcctctcttctttctttctttctttctttctttctttctttctttctttctttctttctttctttaattaacatcaccatcttttctgctattaaactgtcaccatcttgatcttctctccctcttttggcctttactttcccggccagagtgtacttctggtttcttttggagcatccaatctccataaatctcagcctttgacctctctgtctctctgtttctctctctttcactttctctctcttttgaaatagaatttacattttattaaaaccaaacaatccttgcaactctaaaaattgtatttttatggcaccttatgacttcattgttatttatcaaacttcaggtaatagctgattcaaaaagacttgaactataacttaaatattttgtgatttatgaaacttcttaaaacaacttaaagtttatatcttgtggccaaggtactatagacctagttgggaagggcctgcctaagtgaacataaacatcacatttcattgattctaagatacacttttccacattttaacatctcttaaattgggattcatcttatacttcatagtatctcacagtataattggtgaatctttttccttagtattataaaaatgataatgatgggacttataattaaaggcaacttagatttttactttttacttaagtagctgaggcttaagaaagtttacaaagtctgactggtaaccttcacacacagaagttttgtttgcatgtagtccttctcttctttcctgcccttgagatgggatttgttcccttgacctttaccccctttgtgggcaggaactggagtggctcatttcacccagcctgcagtctgtggatggccaagtgttaacagcccagtaaagggtcagagtgacaggctcctgcacctgccctttttgacactcaagttcttgtttggtgtccaggaagaatcaggtcacacaaaccatttgaagggtagtgtatgcagaggatttattgggcgataaaagtggctttcagcaggatggggaattggaaaggggatggtgtgggaagaaggtgatctttccctgaagcctcattgtctgaagttagctgcatctatcagtagtcttcgatgctcagccacatgtatccctgaggctcagcagcttgcatccccaaccacttgcatcagctgcttgtgttgctcttttttttttccctgccagctgatctagtttttatgggcactggatagggggcggggtaggacaaaaaggcaattatttgggtggaaaaatggggtcagctgttttcacttagggccaaggttccaggcttgagggtgaggtttagccgggagcccagcccttcaggggtcagctgttttcacttatggccaaggttccaggcttgagggtggggtttagccaggagcccagccattctgtatcaccctcaccaggttgcttcatgctgacctgcaagtggttctgcttatgctggcctctcatgagtctttcagttaaatctttattggatatgtactgtgtgctaagaattgtggtaactactggagagaaagatgagcaaaatcgtacatggtctttgcttttctgattatagactcttctaaaatagtgttaaccattagcattataaaatggcccaatcataggccagatcattctgttgttcctgtggtgtctagatttcttaatgtttccatgttacataaggaaggagccattctgggtgatcatttaggactctgtatccagtgaccctgtatgggtagagtaacagtttgggttgactacttgaaggtggtttacctccttcatgccttcatcatttacttctcagaggttttcttcatactgcctgtatccaatacgttgcatctgtttttgtcaaacttttcaatgaattatgtatagcaagtctaaatggagttgccttagggtttagtttccctctttactcagtgattatttgatacagctccagggaagattccactgggaatgtgtgtcagctggcacttgctcaagcctacagtgaagctgttatttcatttcttatgtttagttattcttaagaggttggtgtctgggttagagttttcttagtcccctacctgttttcttagcattcgctgctggaatctataaccaactccccaatggactgcaggtagccaacatgcactctcttggtagggccttgcccgcattgaactttgcatttgtttagtaaatttaattaattttgtatagattataaatgtacttagcacaaaatttaaaaagtacaaaaggtaaacaataaaaagaaagtctactttttacacctggctcccagccaccccattgccatcccaggaagcaaccatagttaccagtttctctagctccagtattttttaaaaataactttttattatgtaaaatcaaaaatgtatatggaagaggataatataaagaacctcctggtatccatcatgttgctccaacaattatcaaaaaataaccaatcttgtttaactctactcccacccactttcttggattattttgaagtggatttcatactaaaatcatatgatgtttcagacatcataactaaaagatagtgcctcttttaaaaaacatatagccataataccattttcacactaaaaagcaaaaataattccttaatatcattgcatttaaaatttttcaatgatgtattttcttttcttttacagtttggttgtttgaatcaggatccaaacaaggtccacacattgcattttgttaagtctcgagcctcttttaatctatagctcccctcacttttttttcatttatttgtggaaataactgagttgtttattctgtagaattattccgcgttcttctgattctgttaccaaatatagtctggtgactgttttttctatacattggtattttgatctagacgcttaatcagttgtaggtttaattttttggcaaaaatactttagaggtggtattcagttttaattttacagattaagccaggtaagttcctggttatttttcatttgtttgttttgttttgtttacaacatggtttttaagtacacgggctctatagtcagactatctgggtttgtattccagctccacaacttagtagctgtatgaccttgggcaagtcctatcaaactcactgcatttctccttatttgtagattgtggatcatagtagcatgtaattcatagtactgttgtgaggaataaccaaatccaatgtgtgtagagcattttgaacagtgtctgtctttgagtaggtattcagtgtacattaactattgtggtactatatttttatttctccattgtcttgtacggtatagccagggctgctgtattgttctacgccagggttcactgtttatcttgtaggcttttgaatgatactttttatggtgctgtacaatgagtagtccgtgtggccatatgtagcagcccatatagtcatacaatacatgaacttgtgttgttcagctcttttatgtttttcatagcactactattttataaacaggatttagtgtctatctggatttcttattcgcaaactcatatatcacattgcctttttgtttctgtacccctcttccttgaaatatacatgtgtttgtgcccatagatacacaccacatgcattttcaaagtcaaagctaaatagtattcctcttacaacctctcttccaactgagtgatgtgaagattatgtagtttatgctggtttccacttaacacatctatggagagttgaggctatcagccagctaccaacaaaaaggaagtgaatcgattagcagcatgcctggggactgtgtagacatgcccacaaacctcatgttgttatatgatctgtccttgggatctggccaaggttcttggtattttaatcaatatgagatagatatttccagaattaggaccccatggggtgacccatgataatctggacatcatttttgtcaagtttaatagtttctctgtgaaaaaaaataatattgtgtgtgtgtctcctccttagatctgacatagaaggcattcatggaaaagtatacctttctatgctgcacttgagaggtggtaggcctgtgcacaggggagaagagattaggtcattaataaaatggtactcatatcctttctaatttaataagtcaatataacttctacagatgtgacactagggaattaaataatacagaatcccgatttttaaagttttctaatgcacaactatttcactcatatgtacacatatacatacatacatgcccaactagccaaacaatatataattatagtaatcctttacaagatgtccgttctagtcttaatcaaaccagtagcaggtttagctcatggagtagtttagatggaatgtgcttaggaaggtctgacttcaaagagcctttagtcagagcccaagcaactttctcagctctctctgatgatttcatttttctcttggctaatatattttatccatcaatgtcaggttgggccagaaatacttgatttcgagatagaagtcattgttttttcaggttttcagaaaaataattacatttattattgtgtattatatatggggatagagacaggtacacatttgttaatctgtatcttccaaggtccccatattgttgactagagttggcagatgggtcacaagcccaacacgtctttacccaggctttttcaggtaaagaaatgcaagttcagattgctctttatatatgtgtttccaaagcagacatataaaatgctcctcataaatcaaccccttgtatttcctttcctatgatttaactcatgtttttgttgatacaggcacatttaatattataaccattcattgtataaaagattgctgttatgttttgctgatacagtgtaaattggcagagttggtcctggcaaatgcagaagtcactgtaacatcttggcccatcctgcctcatattgtatcagtcttcccatatgcacttcctcatattcataatacatatagtattcaagaactttatgtacagcaaaaatatttttacacatatttacttgtccatctaatttcttattcaaaatactataaccaacaaattcgtcactgtggtttaatcacaacacagaaacataccactgatactatatgccatggtttataataagcactttgtaaatttttgcttatttaaacctcacatcatgtttatgagttaggtgttattattattccattttacagatgaagaaagtaatgcacaaaatttaagtaaatttcagaaagtagaccctgaatttgaatttagatattttgacactaggccaagcgcggtggctcacgcctgtaatcccagcactttgggaggctgaggcgggcggatcacgaggtcaggagatcgagaccatcctggctaacacagtgaaaccccgtctctactaaaaatacaaaaaattagccaggcgtggtggtgggcacctgtagtcccagctactcgggaggctgaggcaggagaatggcatgaacttgggaggcggagcttgcagtgagccgagatcacgccactgcactccagcctgggtgacagtgcgagactccatctcaaaaacaaaaaaaaaaaaaaaaaaaaaaaagaaaagatattttgatactagtatctgtgctcttaaacactgccatttttactactaaaattgtgacttgttacacttgcctttgtttctttgttatacacacacacacacatatatttaataactttatatttaataatatttaatttgattaaaatttgaattaccatatgtagccagtagtggccctattggacagcacagattccagcacaacacgtaacttagggatgacactcaatacatatttgcttaaggaaggaatgactctcagatttatttttccagctcagatctttcccttgaccttcagacttatgtatgtaatttcttatttggcaccttcactgaatttctattagacattttcaaaccatctattagacagttccaaagacatttccaaatagttcatgtccaaaatgaactattgatctttctctccaagcatactccatccataagcttctccatttcagtttcttctactctctcagactaaaaacttttgtcatgtatgatttttgacagctaatctaccaacaaattctgtagggtcttatttcaaattatatacataatctgaccacttctagtcatctccaccagttttactaaaatttaagccacagccatttttgttccatgttattgaaatagaccttttatatgtctcttttctctgctgtcccagttacgctcttactgttgtctacacagcagctagactgttcttctgtattcaggccaagtcagagcagaccattcctctgtttaaaactcaccagtggtttctcatttcattcaaagtaaaagcaaaggtccttccaataacccaaaaggcctatataatagctcccgctcccctgtccaataccctattctctctcttggtctcatcatttttaatactctcccttctttattccactttactttcactggcttccttattgtttatttttttaagaaggcaaggtaaacaaatagcttaagtatttttatttgtttgcaactaagcttgttaacactatataatgaaaatgtgcaaagaataatgttgcagttttcggttagatttaagtcaaagatattcattaataaggaatcttcgaacgtgaatattccagaaatttctctaagccatctgatcagaacaactgtctctgagtattaccttactttgtaaggtattggcatgcatttgaattaaactcagattttttcaaaataagtcctgattaaaaaaactattctatattcaaactaaaagaatataaatagaacttttcctttccagaaacaataaaggaaacaaggcattttgtaaaatatggtcctgagcaagttgcagtaaaaaaataaatgtatacttctacctgctcaaaacagaggctactttcttttcctcagtcttggaaacaaggtgaagaacagcctaaatgtgacttcgggcaggcggttgccaaaacagctcaagcagttgaccatggacacctcaaatgaatttgggagaacctcaccaaaggatccaaattctatttttaataactgatacaaaggtgaagtggctcttcccaagtagcagtgctgccagggcctggccctggcccaggcccaggcccagctctgagcttacctgctatgctcccaagcaaaccatgatccttctgctccagggcagaccttttccctttagaggttcagtgtccagggagctctatgattgtgtgaatgaggtgagcgccgactccatgtgagtattttaaggcttggagtcaaagtatttttctaacacgcttaggcagagtccatgtgtcaatggcccatctccagtttgttctaatttctcaccacacatttgtagatatttctcaccacacatttgtagatctaggaccacagacctttgctgtattatcataatcacagctaatgtccatcctaacttatgattcatattctatgcctggaaacagtccctgtatttaacaataaaacctacacataaaaacaatccactgttgcaacttatatggtcacaaaacgtaaatgatcttctgtagaacaagcaattttttttttgttttttgtttttatttatttatttattctttgagacagagtctcactctgtcacccaggctggagtacaatggcgcgatcttggctcactgcaacctctgcctccctggttcaagtgattctcctgcctcagcctcctgagtagctggaactacaggtgcctgccaccatgcccagccaatttttgtatttttagtagagacgggatttcaccatattggctaggctggtctcaaacttctgacctcaggtgatccaagcacgtccgcctctcaaagtgctgggattacaagcgtgagccacagcgcccggccaagcaaatgtttttaaccataattgtcatgaatcaagctcagccagaatccccaagatcaaaaaaaaattgcactatacaaataataacttgaaatatacatacacacgctctcatacacacttcttacagaactgtgcttggggaagctccatttgttgagtgccactgaaggcatattttgctaaactgcttctccaagtattttgttttggaaaatctatcacagtagggcacagctgtttactggatgagcagaaaaagggagatatgcttgtggcaaccaaaaagttttaaggtctttcaagttgtataaaatggacctacagaaacgtttaagtgttctcaggatgcaaaattgaagctgaaatgtgttgtcaaaccagttgcaaaaagtgtacagcaggcatctcttgaggttaaacctggtacccagatacataacaaagcttcaggacacatggcttgttggccttgtcccataccgttgcataatctgatcatgtgtgaatttcacaaaagattcattcatattgttctgctagtttggtattgaggatttgctcatactcctcctgaatcttgtcttcatagtctaagacacactcacgtattattccgatttgtcagagggtaaatgtgggctggtccttcttcatccatgaggaacctggagagctaggtgctatgagtgctgaggagtgaggttgactttctgaagcacaagcttcactctgattaagaacaatttctaaatgtctccacctctgataacgactgtattctagttttatgttctgaaaaattttctccggaattgtaaggcgccgcttgctgccgagtggggcggactgctgcagagttggcggtagggtctgcgtctgaagcggcggcggcttggcgtccgggggcctgaggcccggagtggggctgggcagaggggtgcagcacggctgcttcggggaagcagggactcagcagctttgtaccgaagtccatgggccgcttcagcgtcgcctggttcgccaggtcgctgacgggccagggaccgggagcggactcgggtaagtgcggcccaagctccggctcctcagtggggctcgccagccaagccctattgtttctttttctttttttcttttttttttttttttgacacttagtatctcaacattttattattatttttttttaattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttgttgttcttgcgatagtttactgacaatgatggtttccaatttcatccatgtccctgcaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatcacgtatttcaaaataataagagctatctatgacaaacccacagccaatatcagactgaatgggcaaaaactgaattttcctctaatcgcctcattaaatgtatcccacagattttgatatgtagtgttttcatgatcatgttttaaagacattctgtgattttaatttgtatttctttctttaaagaattatttaagagaaagcttataattttccatgcggaatggacttaaaaagtgatttctagctttatcgtagtattattattagacaatgtttataacatgtcaactttatggaacttactgatgttttctttgtaacctaatatatgatcactttttgtgagtatttcatgtgcaactgagaagtatagtctctattaccgggacataaaatatgatatatatctgtaagattgttatttaagtcttctacatctttacttactgtttatccacttgatttgttgtttaatgaaaatgatgtgttaaagtttctttttagtgtgcttttatatacatcgcctgtatttttgctttataaaggtggtgtctgtattactttatgcacagatattcataattgccatatctttatttggagaatggcttttagcatttaaagtgttctttgtggctgggcacagtggcttatgcctgtaatcccggcactttgggaggccgaggtgggcggatcacttgaggccaggagttcaagaatagcctggcctacatggtgaaaccccgtctccactaaaaatacaaaaattagtggggtgtggtgggcacctgtagtcccagctactcgggaggctgaggcacgagaatcgcttgaacctgggaggcggaggttgcagtgagccgagattgcaccactgcactccagcctaggccacagagcaaaacgccctctcaataaataaataaataaataaataaataaataaataaataaataaaagtgttctttgtttaatttaatgctttttggcttgaaatctattttgtctgatattgattccatttgcctggtagacttttgaccattcctaaattttcctcttttgcttcacattcctttaaactcccagacttcacagggtatctctcccttattttttgccatcttctctcttacaaatgatacctttcaaagtctgccttttgacaactgcatagaaagctcttccccaaggctcgaatctaccagtttgtcattatttttacgctttgtgtggactttgtctttctggttgtgatttagattactcttaggctactagccccttcttttctcattaactctcctgtttcagcattgtccttgctccctggaaagacttgaagagggaatatgagtgatatcttgctgagatttctttttttttctacttacaatttaatagttaagtcttttattatgtgggtgttttctttctttttgttatgtgaagggcatggctttatgtacttttatgttgttctggtggctctatattgttttgtggaggatatgtttggaaattttgatttacatagtcaccattgtcttaacataatattttccatatggttaaaaatactttgtaaatattttaatggctatatactatgatacaaaaatataccaaatttttccaataatttccctctttagtatgttagttttttccttttatgtgatgacgtatttgtgcataagttaattccactacatactttgggtagatttgccaaaatataatttttgcctcaaggttataaatattattaataatcttgacatagtttgaatacagggagaatcaattggcatatggatttatattaagctgctaactagggtagcctccatccttttttcaggtagcaccttcctcttttacatatatatcatgagcctggcctgaaatagctagtaggtaccagtgtggctgtttctggtgtttacagccagcatctctgttgagtgatagaactttgtgccaatattagttattaagtatttggagatcttccacctccacagattataacatttgttattctgtggttggattttctttacttaggacacacacttgtgttatattcagcaataacaaaagaaccaatggcctttctttcagctgtcctttagtctggcatccctggattttataattgaagaagaggggtgatatttaagagcccaaaatacaactggcaagaccttaacttggagaaactaatcaatcctcacattagtcattactgcttttgtggcttatgtcagagcatgatgggcttatttctgctcacgctttctgttagtcacttgtttttcctctcacttgatctgttttatcaacttcagttaatcaaagctgggcttcctattcatgcaactagatttttctcagtaatattatattatctaccatttcctgaattaattgagacactctgacatgatctgtgtactttaggtaagccattgtaactttctatagttgttttgtttggtttgcctctgaatgtaaaaatagcattgtgtgagaacacatttgagagtggtggttagggtctttaccaatatattttctatgattatttttactttcaatcttattattcatcacattacatggtagatggcttagcaatatttagacagtaattccacaaaccactttcatcctagaatcacctttgagacattattatttttttaaatgcaaactgccaggcctcatcatggacccaatgaattaatctcttgcattgggatccagagatctgcattttaaacatctgcccaagtgactctcatgcagtttggtacctgactgtagacttatttttgagatgcaaagtttaatgcataccctaccaaatcatgaccccagtgcacctcttaagtggtcatctctgtgctagtttttagagcttgtcacccttgctgtatatacatggcatgctccagggtgcatttaaagcgttattttctacatatgtttagaagtcattccttaacccaataacctattaaaatccacttatgttttatttgtattatttagtggttttattttacattttatctcctccatgcacttgaaattgaatatgttgtttggttgtgaaatagagatctaacttatttttttcccaaatagttaattgtccatgttccattttttgaacaattctgctttttttccaccaatttaaaatgccgcttttattgtacattaagttcttacatttatacgatggtcttatcgtgagctttcattttttccactgacctaactattcttatactactatgaccatgccacataatcattttccttttgagtagcacaaaccttccataattattctgtttaaaaaatgtttcactcattttgctagtttattattccatgtaaactttagaattattttatcacattccagaaaattagcttgttggcattttgattacaattatactaaatctattaattaattggaatgaagttgacaacatgcaatatttagtctttctatccaggatcacaaaattttgtttttcatttacggaagtctttttgtgtgtgtaatacttttatttatattaattctgagacttaaataaatcactctcctctctctctctcccacacacatacagtgcaactgtttttttctattacaattttgaagtgtctgttactaatatataggatgcttatgatttttatatcttcattcactgaccaggaattttaacaggcttccttgttaatgttaaaaacattatcaataggtctaagcatggtggctcatgcttgtattcccagcactttgtgaagccaatgcgagaggatcgcctgagcccaggagttctagaccagcctgggcaacataatgagaccccatctctacaaaaattaaaaatacaaaaattgctgggcatggtggtgcgggcctatagtcctatctactcgggaggcagaggagggaagagcccttgagcccaggagtttgaggctgaagtgagccatgaccacaccattacactgcagcctgagtgacagagtgagaccctttctggaaaaaaaaaaaaagtatcagtaatttctcttgcatttttcagttagacagttatatgataggtaaataatgattattctatctcctttccaataggtttaacttttctgtttttgtttctttttaaaattacattgagaacccagttcctcaccacctttgctgttcattaaactcggtgaagagttttttaaaaagtatcaggactcacctgaatcagagattctggtttacctgatgtagggggaatgtgggtattgtcatttttaaaagcttctcagatgtttctagaagctgtgtttgagaatcattgttctagacactctgaccaaatgataagtagtactagtgatagcagacatccttttctggcttctgatcataagcttctagtattgcaccattaatggtgatatgagctgatcatttgagattgactcagtggtgtgttggaggcagctggtacctgctcaaaaggtgtaactgtacacatattttcccaacttcacattcattgacattatgttgatcacttcaaatcagccatggttgattcacatggaaattgacaaatgctaaaatcagcgctccccaccttctctgtcaacctgttcattatttgccagcacatcacagtagatctttattagcttaaagaagtattcttttttaaaaaaaagaaaaaaataagaagtattcttttattattaggctatgaataatttttgtccttcattatcatttgcatttcattgcaaccaccttttaatcacattgtcaccttatatcagccacgttctaaaaccttgtgtttctcactgtaaatgcttttttccagagggattcctgtattctgattcttcagagagttttccttctattaaactacattgacttttcctaaacctaataactctttttatggaggaaactttttttcttcttcatcttccctcctcctacccttcctgtcctctgatactcaccagtctactctctatcttcatgagatctacagacctaagaacctttttagtttgttcttttggttggtttatagacaagcaagagtcaaatttgagtttgtaagatatcagtgtgagttcttgcataaaaattccagatacaaatgagtaaaaaagtttaaaattcttctaataatcactgctgtggtgagccacggattcagaaggtagggtgtttgggtggaaaagagtggttcacagtgaccaacctagaggaaaagatggactgcatgttcttcaggcaatcctctatgaatactgtcttgtcacaaagatgtatgtaagaattacagactatggccgggcacagtggctcatgcctgtaatcccagcactttgggaggccaaggctggtggatcccttgaggtcaggagttcaagaccattctggccaatatggtgaaaccctgcctctactaaaaatacaaaaattagccaggtgtggtggcacgcacctgtaatcccagctactcaggaggctgaggcacgagaatcgcttgaacctggtaggcagaggttgcagtgagccgagattgcgccactgcactccagcctgggcaacagagtgagactctgtctcaaaaaaaaaaaattgaattgcagactataaatctggaattgccattctctgagaagtaattataatgtacaaatcaccatctagtcagataaatgtagaccaatatgctatacaatcaagctgaaattggagttgacagtgtcttgtgaatattagggatcctaaacagacacatggctaaattggtgtttattttcactgagaatggaacaggccttgggcagggccatgctttttctatacccagatttttgagggtttttatcctgaagggatattgaattttgtcaaatgctttttcagtaacaattgaaattatagtatggtttttgtccttcgttttattggtatgatgtactgtattgatttatttgtgtatgttgaaccatccttgcatccctgagataaatcccacttggtcatgatgaaggatttttaaaatttgttgaatttggcttgctagtattttgttgagggtatatatgtgtgtgtgtgtgtgtgtatgtatatatatatatatatatatatatattgatcagtggttatggccaatagctttttgtttgtttgttagtttgtttttttgatgtgttttggtctggttttggtatcagggtaatattggcctcgtagagtgagtttggaagtactccctcccccctctattttttcagaatagtttgaataggtttagtattagctcttctttaaatgtttggtagaattcagcagtaaagctattgggtcccagacttttctttgctgttagactttttattatgcctttgatcttgttccttgttattggtcggttcaggttttggatttattcctggttcaatcttggtaggttgtgtgtgtctaggaatttatcaatttcttctagttttccaatttattggcatatagttcctcatagtagccactaattaccctttgaatttctgcagtatcagttgtaatgtctcctttctcatctctgattttatttattgggatattctctctttttatcttaatctggctaaaggtttgtcaattttatgtatcttttcagaaaaccaactttttgttttattgatctttttgtattattatcatgtcaaattcattttatttctgctctgatcttaattatttcttctactaattttggatttggtttgctcttgcttttctagttctttaagatacatcattaggttatttatttgaagtttttctttttgatgtaggcattatagctataaccttccatcttagtactgcttttactgtatcccatacgttttagtatattacatttccattatcatttgctttaagaaaatgttcagttttcttcttaattttaccattggcccactgatcattcaggaggatattaatttccatgtgtttgtatagttttcaaaattcctcttcttattgatttctagcttttttttccattgtggtcagagaagatacttgatattatttcagtttttttgaatgttttaagacttgctttatgggtgggtgcagttgctcacgcctgtaatcctagcactttgggaggccgaagtgggcagatcgcttgagtccaggagttcaagaccagcctgggtaacatagtgaaaccctgtctctactaaaagtacaaaaagttatccaggtgtggtggcacacgcttgtagttccagctactagtgggggctgagatgggagggctgcttgaacctatgaggctgagactgcagtgagccactgcattccagcctgggtggtggagtgagaccttgtctcaaaaaaaaaagacttgttttgtgacctaacatatggtctgtccttgagaatgatccatgtgctgaggtgaagaatgtgtattctgtagccattggatgaaatgttctgtaaatatctactagatccatttggtccatagtgcagattaagtcgaatgcttctttgttgattttctgtctgggagatctgtttaatgctgaaagtaggggtgttgaagtgtttagctattatcctattgaaatctacctctccttttagctctaataatatttatatgtttgggtgctccagcattgggtgtattatatttaaaattgttatttcctcttgctaaattgacccctttatcgttatggggtcataatgatcttctgaagatttaaagtagtgaagggaaaaaaaaaacttttattctagaatagtatgtctagtggaaatgtccttcaaacatgaaagagaaataaagactttcctgacaaacaaaagctgagggatttcatcaatacgagatctgtcctacaagacagatgatcttctttgtctcttacagtttttgtcttgaagtctattttttctaatataggtatagctactctgttcttttttggtttccattggcatggagtatcttttttccacccttttattttcagtctatgtgtgtctttacaggataaatgtgttttttgtaggcaagagtcatttgatctatttttttttatccattcagctactgtatgtcttttgattagagagttttgtctatttatattcaatgttattattgataagtaatgatttactccgtcccattttattatttgttttctgattgttttgtggtcttgtcttccttcttttcttcctgtctttttagtgaagtagattttctctagtggtatgattttaatttcttcctttttattttttgtgtatccattgtatcttttttgatttgaggttattaagaggtttgcaaattctctcttataacccattattgtaaactgatgacaacttataactgatagcataaacaaacaaacaaggaaaaaaggaaactaataaaaactttacaccataattttttctgcccacttttcagttttttgttgtttccatttatgtcttgttgtactctctatgtctttaaagttgttggagttattatttttgattgattcattgtttagtctttctacttaagagtggtttacacattacagttacggtgttataatattctgtgtttttctgtgtacttactattaccagtgagttttatatcttcagatgatttcttagtgctcattactgttcttctctttctgaatgaagtactctctttagcgtctcttgtaagatagatctgctattgatgaaatctctcagcttttgtttgtcttggaaagtctttatttttccttcatgtttgaaggacattttcaccagatatactattctagggtaagagtttttcttcttcagcactttatgtcatgccactctctcttggcctgtaaggtttccactgaaaagtctgctgtcagacatattcgagctcctttttatgttacttgtctcttttccccttgctgcttttaggatcctttttttatccttgatcttgaggaatctgattattaaatgcctttagatattcttgtttgggttaaatgtctctggtgttctataaccgtcttgtacttcaaagttgatatcgctgatactatcccactgaataagcttgctacccctgtctctttctctacctcctctttaaggccagtaactcttatatatgcccttttgagactattttatagatcctgtagtcatgcttcgttgtttttcattcttttctcttttgtctcctctaaatgtgtattttcgaatagcctgtcttcaagctcatcaattcttctgcttgatcaattatgttattataagactctgatgcattcttctgcatgtcacttacattttttaactccagaatttctgcttgatttttaaaattatttcaatgtctttgttaaatgtatgtgatagaattctgaattccttttctatattatattgaatttatttgagttttctcaaaatagctattttgatttctctgtcttatatgtcacatacctctgtttctccaagattagtctctgatgccttatttagttcattttggaaggtcatattttcttgaatggtcctgatgcttgtgaatgttcatctgtttctgggcatctaagagttaagtagtgtagtctttttagtctgggcttgtttgtacttgtccttcttgggaagactttccagatatttgaaaggacttgagtgttttcatccaatccatatctgcattagagagcatcccatacccagtaattctgtggttcttgcagatttgtagcggtaccaccttgatggtgttgaataagatctggaagacttctctggattactaggcagagactcttgttttctttccttactttctccttttacttttaaagtccacttttacttttccctctacttttctgaagcagaaggagtctctccccacagctaccacagctgggaacgtgttgagtcatacctgaagcccacaaagtttcgtctaaggcccaatgagtactatctgggttttgcttctggttatttagggtccaaaggttctttagtcagcatgtgatgggtcctgccaggactgggttcttccattcaaggcagtgggttcccttttggccccaggtgtgtgtagaaatgtctgggagctagagtctggaaaaggggccttaggactctgatgagtgctctaggctactgtggctgagctaatatacaagatgcaagacaaagtcctctttactcttgccccctcttttcctcaagcagaaggaaggggtatcttttggagccttgagctgtgctgtgtggggtggtgcaaggactcccatagccaccatggctggtgtctcagtaggttgcatgcctcccaaattcactggctctgagcccagttcaacactaggactaatataagagttgcagtccttgtggcttagagtgcccttcaagtttatttagggatccagagcactttagcctgcagtgtcaaggcttagaactaggatgtgtgattcccctctagctagggctggtttaaatgctccctgtgtgggttgtccttagctgagttcagcctgattttgctttcttccatgtgacagggtagcacggagttcaatgcagtgtctcacaattgctgcactctctctttctgaagtgcacacattccagtgtctctttttttggagaaatgtttgctcatattttcttacccattttttacttgggttatttgttttcttgttatttagttgtttgagttacttctatattttggatatcagccccttatcagatttatggtttgccaatgtttttacccaatccgtgggttgtcccctcactgtgttaattgtttccatttctttgcagaagctttttagtttggtgcaattccatttgtctacgttagcatttgttgcttgtgtctttagagtctgatccaagaaatcattgcccagacaaatgtcatggagcttttcacctatgttttcttctagtagttttatggtttctggtcttacatttaagtctttattcattttgtgttgatttttgtatacagtgtaagatagagtccaatttccttccgtatgaggatatccagtttttccagcaccatttactgaatagagtatcctttccctgttgagtgttcttgacacctttgtcaaaaaatcaattaactctaagtacttgggtttacgtctggactttctgttctgtactattggttgattggtctgtttttatgccagtaccatgctgtttatatgtgattataataacttcataatatattttgaagtcagagaatgtgataccttcatgttttttccttttgctaaagattgctttgactattcagggtcttttgtcatttcatatgaattttatgattatcttctatttctgtgaaaaatgacattggaattttgataggaattgcattgaacccagagaaagctttgggaagtatggacattttaacaagattagttctcctaatccatgaacatggactattttttcatttatttgtgtcttcagtttgttttatcagtgttttatagtttttagtatagcagttattcacttccttgactaaatttattcctaagttttttctttatttaatactattgtaaatgggattgtttttgaaatttttttcaaatagttcattgttagtctgtagaaatgcgactgatagaggctaaacattactctgatgttcttgtttttgcctcctctgttatttttggtttggcctaaagacttaaatatcatctgagaagcacagttcttttagtcatatttccgtggttacatatgagcccagttgatacggtggtaaggtgtcatgggtggggaggtcttctataagattatgtctctgtcttttagtgagctgtgcccctggcctgtgacttacttaagttcttctcaggaattttttttccccctcttgggagagatgggaaggcaaattgggtctggaattcggtatttcccttcacctcgttcgcttaggttctgataaaactccaggaggttttgatctggtaaaaatagtttctcttgagggaagaccttgttaagaagaagagaagggtctgtgaatatttttaaatgactacttatctttcccccctgctggaagcatgaggggatttttcaccatcaaaacttgataggactcttgtaggtaaaactcacaaaagtttgggagccccttttggactgggccctattggagtttttacctctcaaatccgagcatattaagcctccagcaatttgtaaattacagattaggttatcctatcccagtgctggttcgcaaggagttttctactcctggccttctgttactgtaagatttggttctctctatctatctcctcacttctggggacagccatttaccctatgaccccagttatctgatgaatctaagaagagttgattttgtttgttcagttttttcttgttgtgtgaattggatagattactttcttatttcttatatggcagaccagaatgcagtcatgtttttgaaatatcaaagatttgcttcttctaaagttttgatctcttaaaaactacttagggtaatatactttgtttttcttttaaaagagggaaaatgtaagatttttttgatgattaacttttgttttttgtttacttttctcaaatagatcctaaatgcccaggagatgttgattttcataatagtgactgggacattaagacaatcaccagctccttgaaattctacctcaggtatgcctgatttgaattgggagtttgcttttcatagctggtgaaatttctctgggtgttgagcggagttaacgtggtctcagttccaggagtttggatagaattgcttaagaaaaaacatgtgaagaggatttctggccaagaatgtgcaaagactgttttttaaatctgagagtttaagcaagagaagcataaaaataatagaattgttactgaaaaaaggctaaaaagattatgttcaaaaaacatgcacttgaaataattgaatacgttttgctcttcacagatagagtgatgttgtgatggattcactagtagaatcaggagctgggactattcagggtggctaacatgttttagaggataataaccattttgaaatgtcaaattgcatttgggcaaaaatggtatatgtgtgtgatgtgctacgtatcatgtcttaatccaggtaatggaaataaaaaccaagaaaatacaactgtaataatattggagctaaatgaactgtcagcagtatggaaaaaagttagctcaccaacaaaatttgggaatgtgcaatattaatgaatatattgttcagtttattggcataaatttatattatgcaaaaggtgcttaagacatatatattttttaaacacattgatttcttaccactctttatgtctcatagtatgtatcatactttatgtgcaaaagcctcttcttttcaatgattgtgttcttgagccattaagattgatacataagttctgggaaatctcattaatctaaaatagattgggtttcagatattactgttaaatattttgctactgtagcatcatcttagagctttccataaacttgaatgttctttccaggaatatttctcctgcatctgctgataaagaaaagaactgttattggagggtttattctgtactaggctacggctagttgtttacactgatagtgtcattgtttttttctcccattaaccgagtgtactaggtggtacttgactcgttttgcagatgaggaaaccaaggtgcaccactttctccattaagtaatagccatggtcccagcttgtattttttaaatctcagtgtctctgacttataaggcccctggtactggggcatcttcttctcctgccccctactcccaggagctttggccttctttggatggcttggtaatttagtaaagacagagagcaatctgttacaaatactttaagaagacttgttgtgatgagaatagtgggaataagtgattctgtatctctagcttccttcaaaggagtctcaacattttcttagatttgtaaggccttccccacattgcattattcccagctcatcctataataggcagggtggcccttttcaaagatgagagggtcaagcctgaaagtgcgagtgggcggcacccccagtaagtgatatttgttctcgagactctcatccatggttctgtaatatataccagccagtaaataccctatagaattctcaaagatagctgtgttccaggacaggtctccacactctgttctaggtaactaaatcaccccttatctctaacctttccagagaagtcctctaaaaatcatcccttctctctcccctatttttatcctctctcattcaactggctctttttccgagtatgtaattatgctccagccacatacatctttaaatcagtaaatgattcagtaaaaatatcttgactgcttattctatgcccagtgtgatgttaagcactaggcaaacagttgtgtatagatatggtctctgaccttaaagaacttatagcctagtaaaggggacagtcagaagacaaataatcatacaaatgtaataaactctaataagtactctgaaggaaaggtataacgtgctatgaaggcatttaataggaagacgtcacccattttggtttaaactgaggtttgaactgtaagttggaatcaactaagtaggagttgggttccagacagagggaaatgaatacgcaaagacttgaggcaggagggaagaaggccccttcaacaaactacatgaatcagtatagggggagtattgagtgtagagagggagggagaggtatgtaagggccatatcattcatggctttaaaggatcttttaaaaattagggtctaaatttatcttaaaagtaatgggactatattgaaagattttaaacatgaggtgcatattgagatttgtattttgaaataaaaaaggatggagattagattacagtgatataaaatgggcagagatgtggaaatcagttagccggctatggctgtcgtccaggcaagagatgatgctcatgcttggactagggagtagcagtagatattcctagaagtaagcatattcaagagatttgggaagtacaattcatgaattggatatgaggattagggatagggagacaaaaaggtgacttccatgtttctggcccatacaaccaaatgatggtcatgcatttactgatttgagaaacacaagaagactaagtttgagggaggcaataagttggaatttggatatgtcgaatttgggtagctttgaagaaatcagggcacaatattaagcaggcaattgaatacataggtctgaaactcagtgatgagttcagggcttgaactaaaaaattggtgatcattgaccatatagatgatagttacagccaggaacttaaacaagattgcctaatgagatactttactcggtgaggactaaactctgatttttcatcttgcccaaattcctttctaaggggtctggggagtcatgccctccaagccataaattctcatcagatgggttttatttaaccttgtatatcatgacttactttccaatctgactctggcataacaagggagaaaatgaaaatgttttatcccaaaatatattttcttgccataccttgaaattgccctgcaaagtctcttgtgggaaaaatccacattctatagagaatccccttcccccattgttttccttcatttctttccagatccaggagataatcaactaagagccaggtgcccttttaggtctaataagaaacattttacaacgtactctctctaaagtctggtatctgagagattcctccacacaataaaacttggtctccacaatcctttatcttaacctgaacattcctttccattgatcccggtcgtcagataaactcaaccaattgtcaaccagaaaatgtttaaatttacctatagcctggaagcccccactttgagttgtcctgcctttctgaaccaaaccaatgtatttcttaaatgtatttgattgatgtctcatgcctccctaaaaatatgtaaaaccaagctgtaccctgaccaccttgggcacaagttctcaggacctcctgagggctgtgtcacaggccatggtcactcatagttggctcagaataaatctcttaaaatattgtacacagtttcactctttttgtcaacatcagccaagcttctgtgtcaagtaatatacactcctggtctgtacttcttaactccccagttccttcttaactcattgtaatctaactcttaccccctctgctccaatgaagctgcttttgccagggtcaccagggataccctcaatgctgcacacaaagcacagttgtcagtctttaccttacttgacctttttgtaacatttgaagttgttaacaagccttctttgatactttcttctgttttggattctgctgaatcacttgctttttgtttttctctaacctctttggtcattttagtcaatctcctttatgggctttctatttggtattttcctgggctctctgctcattttactatagtagaacaactgaaaactgaaatatctacagggaccaggaaataaaactgaatgaagtagactattttcatattaaacactttgcacattgaacctttatttgtatgacaagccctttgtttacatacaaacagcagtgttgtttacttctacaaagaaccaatagagccagatctttgcatttttcaacagggacaggggatatgggtttgtatatgaaatatctcattttaaaatattttgatcattgattcaattccatttcacttttatacactgtgctggacaaagaagaaatatcggaagacctcatgtagctgtttgactgccagtttgccagctcccctggagaagtggcatctgttcttgtggtttcgtcatctgttctctaggttcctgattttcacatctgcttctctgatctagcagagccctgcatccagcttcttagtagatatcaccttcctgaggcctccctgacttagcatctctacttccctcttaatcaactcttattctattcactcacccaaaccaaactgctcccttgccatcatacccaatcaaagaaggagttctttctttaatatttttcaaaacagtctcctcacctattctttctatgctttgtcacccaggctggagtgcagtgttgtgatcatgactcattgcaggcttgccctcccgccacacccttctctctctcaggctgaagcagtcctcccatctcagccccttgagtagtctggactacaggcacgcaccaccatgcccagctactgtttttaagttatttttaagaggtaggggtctcattcagttgtccagactggtctcgaactcttgggcttaagtgatcctcctgccttggcctcccaaagtgctgggattacagatgtcagccaccatgactagcccctctgtttgtcttttattatcttttgcttggattactacagtaacaacagtggcaggcagtatagtatagtaattaagagcatggactcaggagacagacttcctgcttctgccacttattagctgtgtaattttggatgagtttttaacttctctaggcctcagtttcctcatcgatgaactggaaatggtacctacctcacagagttgttatgaggtttaaatgggttaatacatgtaaatcacttagagcagtacagagtttgctattcttataattattagttgattacttacttcctctgagccacctaccatatacctttattttgtcatcgtacttgtcccactgcattgcaaattttgtgtatggtgctcttttctactaaactattagctcgttggaggtttggactatttctattcatctctggatccccagtacctggcacaatgccaggtacaagtaaatgctcagccaatgtttttttttttctttttttttttattattattatactttaagttttagggtacatgtgcacaatgtgcaggttagttacatatgtatacttgtgccatgctggtgtgctgcacccattaactcgtcatttaacattaggtatatctcctaatgctatccctcccccctccccccaccccgcaacagtccccagagtgtgatgttccccttcctgtgtccatgtgttctcattgttcaattcccatctatgagtgagaacatgcggtgtttggttttttgtccttgcgatagtttactgagaatgttttttgactaaatgagtaaacccatttgagcctgagtttcctcctcccgtaaatggggatttgaataactgctccacctcacaggattattgggaggacaattgcaaaagcacttcggaaattctaaggatctatcaaatcgtaagggattcatggtagcattcagcatgggtcccctctggaattttgcaggactggtttgtgcctctttttacttctgggagctagttggagaccttgctagagggctcagcccatgcttttgcaggtcttttgttgaattactagcaacttggattccctgacgaagcttcaggtgaagagaaaaatgtatataatcccactaagctgtagggctcaggaacttcagccttgctgtccccagaactaagaatccaatacccagctgctttcttcccaaagcaactgacaattttcattcatttcaggaatctttctgaacctgtcatgacctatagacttcacaaagagctggtctctgctgccagtaagtatttatgttactaattaactgtgttgtcctagtttcttaatgtttactgcaataagcctagaaaattgtttgaggggaagtgattgagggcacagaaacctaaaacacatacacaaattatgcacaactgccaaatgaaagtattcttgcttgctgtctaactcaagagttctattatttttcataattagtgttacttaagtgggcttgagaaaattggttaacttgagggttgtgtgaatataaaggctttatttatatatgtattcattgcctcttccatcagaacaagaacattggctcacattaccaggggacagaaaaatggttacacgacagttgccgtttcaacttccttcagcattttgcctgttcaaatgcttttcgactgtgttgtgaaccattgtccttaatctgttagtgccagcatcacattttctagatgagaaaactgagggagagggcgtcagtacataggaaataaggcatagagaatcactcccaaaagttggcgattaaagaagcattgaaagttttggctgaggccactgtatgagtgcccctctccacctcaatgtgacccttattctgcatcatatcctgtgtggtgtagaggaaaaagattcaggggacttaacatcataatgcgtctttgttgaaacaagggagctttgttctttacttctgggctctctcagtgattttaacaggaatccagaggcagcagcacacttctcagtaccacaaggaaggtggatgggaataggtttccagctggaagtttatctgtgagacttcaggaacaacctgctgtgctcagagttctgactccctctgagacagtcttctcttctcatccttctcttttctatcttctattttctacatctttttagacctgtttctttgtgtgtgttttttttctctttttctgccttttttctttctttatgtctttgtctttgtttctgggtctctaatttttattgtatttcagtgcctatttatctctctgtctcttttcatctcattgattatctctctctctgtgtgtgtctctgggtgtctttctccgaatctctctctgtgtgtgtgtgtgtgtgtgtgtgtgtgcatgtgtgcatgtgtgtgtgtttgtgcatatatatgtgagaattttgctcaatccagttgcccagaaagccaaaccatttatctcttactgttctatcccagagtctgacaacctggattaccgcctaggagctattcactccctggtatataagctaccagaaaagaaccgagagatgctggaacttctgataagacacttggtcaagtaagtaactgctggattttcagaaaaagttcctattagaggactggcccatgtggttggactacacagaaactgcctctcagctctttcagccccagcccttaagtgcttccttggaagctgaatgctctgtgaggaaggctattttgccttgacccatgtacatatcctcttagagtcatcatgcatgtggattgtctcagttgaaaggtagcagcaaggtagagtggggtggacacaggctttgctgtcagatgagcctggttttgaattgaagctctccaacttatttgctgtataatctcaggcaaacctctctgagtctgtttggtcatctgcacaatccctacaatgaaggccagttgtgtggattaggatgaacacaggtaaaatgcatgtcacatgagaggctctcaagaaatggcactttttgttaagattctggtcaacttcttgccatggtgtggctggcagtaacagacagcgggatcctggagaatagtcctggtgacaggcactgagataggcaggtgaaaggggcacttgtgtcccacagtggtgcttcctggccagaagatttaatattgtgaatcaagatgaatttacttggcttaaaaaaggcggaaagcattctgtccaggagccagcagacctgggctctagtttcatttctgctttctgctattagttcattttgtgaccagggacaggtcactcttgaggcctctcttggtatatatattaaaaaattgtaatgtattttaagtgtatatatttagcaagtgcagttgtctgcatactcaaaagatgcagtaatgatacattttaacctcatttggagaggctctgaaacacctaaaattgaggcctttaatgaaggtgagtttccaggttaatggctcttttggcctccccctgtaataaatcctgagtgctttgcctatctggacctcgagttttcctattatatgtgagatctccaagatctgattcagctctgactttcaaagactgttttctacacttctatagcaaatgaatattgtggacactgatgtaggtaataagcagaattaacaagagagaatggcttttatatttattgccagtgtttgcaatttgagctaatagagaacattaagaggcatgtggtctccaaaaagtagtttgtgatcatctcagtaaatgtacaaaaatcagcaaagaagctatttgcatgttaatttaaagttgccctggaggagtctttgagtccaagttccagatctgtcacaaatatgctgtgtgacctagagaaagttcctcccactctctgggccacaggtttgtgcatctataacacgaagagactgaagcagctaatctcaaagggttttctcagctctgactttctgagagtctcaacatgtgacgagacccaaggactcaattgaggatgcccgtgcttagtgagcatcagggtgcctgcctctatctgcccaaaggctggctgcttggcttactttaagaatcttagtcctcaaaatcttgaaatcaaaagaagacatgaacaaatagatcacagaaatagaatggcaaatactcttaagtatgtggtaatatgctcaagctcactcatagtaacaaaaatacaaattaaacctatactgagctaccatttattgtcaaatcctaatgcttattaattagactatggggaaactgtcctctaatacatttattgtattaatgcagtacagttccagaagaggggatttggcagtacctaacaaatctacacattcagttatcctttgacccagcaaaacagcgtaaaacagggtatatgatatgttagctttttttttaaggcgtatactctaaagatacacctccaccaatacaaacaacacatgcacaagatttctcattgcagcacaattttcaaaagcaaaagattggaaacaacacaagtatctgaaaataggggactagtcgagtaaataagggtgtattcaacagtgtagtattatgcagtaatttaagaaaagaatgaggaagatctctatgaactttgttttgtggtgattttctgggatatattacaattttccagcacgtaaaacaaacatcataaaaaatctctggctgtaaaacaaggtttataatatgctagcttttcttttgtaagaaaaaagaggaaaataagaatatgtaagaatacacacacatttaaaaaaatttgtcaaatgaagcatacactaagataaatttaaaaaaaactaatgactccaaaagttaaatgtagagttgccatagatccagcaactccactcctaggtatatacctaagataaatgaaaacatgtctccacacaaaatcttgtacacaaatgtccatagcagcattatttcatagttgttgaaaagtggaaacaacccaaatgtctgttaactaatgaataggtaaacaaaatgtgatatacaggcaatggaatattattcagccataaaaaaggatgaagtactgatacatgccacaacatggataaacactaaaagcattatgctaagtgaaaaaaaacaagacacaaaagtacatattttatatgatttcattgatatgaaatgttcagagtagacaaatctatagagaaagaaagtagatgagtggttggcaaggtctgggaagtgggggtatgagaagtaatggggagtaattgataatgagtatgaggtttctttttggaatgatgaaaatttctggaattatataaggggtgacagttgcacggctccgtgaatatactaaaaaccacttaattataacctttaaaaaggtgaattttctgatatgtaaaatatatttcaataaatgtattataaaaataaactaatgaaagtggttattatactggataggtgtggtaagtagggtggaggtgataggggtaagagctagattcctctaagtatacctccttatatacttatgactattaagccatattaatgttttacatatccaaaaaagaaaattaaatcaaaaattataaaccgtaaaactgaacaccaataaaagcaaatgactttaatgaacctaagtgtttatcaacttgatagcataattacagagagaaagcaattatttcaactaacgtgtcaacacagtcctctgactcatccttaatgagatgtactctagaaacaagaagagcaaaattttaagcaacactcagtaggtttattaatagtagtaatataatttaacttgaaacaaacacacagatcttataaagataaagcaaaaaagtaaatatgttaatgttatcacaagctaagtttatagtgtacaaaagagatactgataaaaaagacataaggaaaaaaaattttaacattaaaattaaattaagaatgttaatatgaattcatgatttaaagagaaagcaacaagaagaaaaaactttatccactgaaacagtgtcgaagggattctacccaaaaagaagtgaatacacttagtgcccagttttttgtttttaaatagcatttccttttcaaaggaatcaggggtgcttagagaaatggctgattgcatgtctggagcaaggaaaatacaaagttagtcttggataaatagtaccaccaagcaagaaagaacagagtcacactaatagtgtcatgtccaaaggacgtagaaaccttgaaagggctgacactgatgatgtttgagccaacctgaacatcaataacaataaataatgtatttgattattacatgttgaaaaacaaaactcctggaggtgggtagaggaaggaaatctctttattgcagaaggaataccagctaataaacataggaggaatgacagaattagaaaaatcattagtttgcaatctaagtgatctgttttagacatgaatcaaaactattgggcaagagtattgaggaataggatgttcacattattccagtgtattactgacaagttacttactaatcacaaataaaaaacaatgtatctttacaatgaacctatctggcagacaccaccttaagtaattgatcaaagttagcatcagtaataacggaacaggccaagtgcagtggctcaggcctgtaatcctagcactttgggaggccgaggcgggtggatcacctgaggtaacgagttcgagaccagcctggccaacatggtgaaactccgtctccacaaaaacacaaaaattagctgagcatgatggtggatgcctgtaatcccaactactctggaggctgaggtgggagaattgcttgaacctgggaggcagaggttgcagtgagccgagattgtgccattgtaaataatggaacaaaccaccttatgtacctcctaattagacataataaaaattataaaacattaactgtgaaatatttttgccaaaaatacgtagcctgaatcaaattaattctttccaatttgcaggaaataaagagtatagaaaaacacacagtatttgacagtctataaagcttttgaaaaggcttggacttttcaaaaagtcaatgttgtgggaaaaagtggtagaggtactgttctacataaagagactaaagaaacaaacaaatacagtataagagctttgtttggatccaaatttgaaaaacgcagctataaaagactttttctcccataacatttgagaaaatttgaatatggactagatattagatgatatagaatctacgttttctaagatgcaaacatgttattgtggttttgtaggaaaatgtgcttattctttgatgatgaatgctgaagtatttagggttgaagcaatgtactttcagaggattaagaaaaaatatagacagaataaaagcaaatatggcaatatgttaatttttgagtctaggtatagacagtatgagtcttcctagtaccactctttcaactgttttgtatgtttgaaaatgtttataatgaaaattgtagggaaatgtaaataaaaaataggcttagtttcaatagagaaatttacacaggagaagaaaattcaagtgtttttaaaatgcacataattatcttgcctgtcaactgctgctttcatcatctatatgatgagtacatctatgcctttgtactgtgtttccactgacagcctgttttctaggctaataacaggcagaaccaaactgaccttagccaatttgaggttctcagttatccagttctttttggttagtatctgtagcttctattagtcagaagtaggagaactctaaggccacctccctggcaatcttactaccagtggaatattacaatggaagcaagctccaggcctaattctgccattcttatagctatttatcagcaggcagacgaaaaaagacttgaacaacctgttctgcaaactcaaatgaagtcccagctctctgtcctttcagatgccctgcctgacaacatcttggatgaaaggttcactggaggcagataagattggagtcagacaataaaatcctaccatctagtacccctatgtaaccttaggcctgggctaccattctgaagggtatgggttattagcttactaggttctttttacttttgtaataatacttctcttatttgagaagcaatactgtgcattgtataaattagaaaatttttaaaaagcaaaaaaaaaaaaaaaaaggaaaagctttctattcccaacattcaataatcattactgttaatatagttcaggttttttcggatctctctctctctctctctcttctctctctctctccctctttttctctctctcgttgtgtgtgtgtgtgcatgcatttttgtatacacatacctgtttgcatttttttttaccaaaatgagattatgctgttctttagtctactttttccattttaacaattttgacttttccagaccatattaactttttcccatttgacccaaaagtggccttttataggtgtttgtccaatctggtattcaatataggaacacattttatttatgtccttattgtgtttttaatctagcacagtgcttgtttctattattattattattatactttaagttctgggatacatgtgcagaacgtgcaggtttgttacataggtatacccgtgccatggtggtttgctgcacccatcaacccatcatctacattaggtatttctcctaatgctgtccatcccctagccccccaccccccgacaggccccagtgtgtgatgttcccctccctgtgtccatgtgttctcactgttcaactcccacttatgagtgaaaacatgtggtgtttggttttctgttcctatgttagttttctgagaatgatggtttccagcttcatccatgtccctgcaaaggacatgatctcatccttttttatggctgcgtagtattccatggtgtatatgtgccacattttctttatccagtttatcactgatgggcatttgtgttggttccaaatctttgctattgtgaatagtgctgcaataaacatacgtgtacatgtgtctttatagtagaatgatgtataatcctttgggtatatactcagtaatgagattaccaggtcaaatggtatttcaggttctagatccttgaggaatcaccacactgtcttccacaatggttgaattaatttatgctcccaccgacagagtaaaagcattcatatttctccacatcctctccagcatctgttgtttcctgactttttaatgactgccattctaactggcgtgagatggtatctcattgcagttttgatttgcatttctctaatgactaatgatgatgagctttctttcatatgtttcttggcctcataaatgtgttcttttgaaaagtgtctgttcatttccctcgcccactttttgatggggttgtttgtttttttcttgtaaatttaagttccttgtagattctggatattagccctttatcatatggatagattgcaaaaattttctcccattctgtaggttgcctgtccactctgatgatagtttcttttgctgtgcagaatctctttagtttaattagatcccctttgtcaattttgacttttgttgccattgcttttgctgttttagtcatgaagtcattgcgcatgcctatgtcctgaatggtattgcctatgtttttatctagggtttttatggttttacgtcttacatttaagtctttaatccaccttgtgttaactataaggtctaaggaaggggtccagtttcagttttctgcatatggcaaaccagttttcccaacaccatttattacatagggaatcctttccctattgcttgtttttggcaggtttgtcaaagatcagatggttgtagatgtgtggtgttatttctgaggcctctgttctattccattggtctatatatctgttttggtaccaggacaatgctgttttggttattgtagccttgtggtatagtttgatgtcaggtagcatgatgcctccagctttgttatttttgcttaggattgtcttggctatatgggctcttttttggttccatatgaaatttaaagtagttgtttctaattatgtgaagaaagtcaatggtagcttgatggggatagcattgaatctacaaattactttgggcagtaaggccattttcatgatattgattcttccaatccatgagcatggaatgtttttccatttgtttgtgtcttctcttatttccttgagtggcagtttgtagttctccttgaagaggcccttcacgtcccttgcatgttgtattcctaggtattttattctctttgtagcagtcgtgaatgagagttcactcatgatttggctttctgttattggtgtataggaatgcttgtgatttttgcacattgattttgttttctgagactttgctgaatttgcttatcagcttaaggagattttgggctgagaccatggggttttctaaatatacaatcatgtcatatgcaaacagagacaatttgacttcctctcttcctgtttgaataccctttatttctttctcttgcctgattgccctggccagaacttccaatactatgttgaataggagtggtgagagagggcatccttgtcttgtgcctattttcaaagggaatgcttccagcttttgcccattcaatataatattggctgtgggtttgtcataaatagctcttactattttgagatacgttccatcaacacctagtttattgagaggttttagcatggagggtgttgaattttatcaaaagccttttctgcatctattgagataatcctgtggtttttgtcattggttctgtttctgtttctctttcccgatttccctggacagaacttccaatactatgttgaataggagtggtgagagagggcatgcttgtcttgtggcggtttttaaagggaatgcttccagcttttgcccattcactatcatattgcctgttgatttgtcataaatatctcttattattttgagatatgttccatcaatacttagtttattgagagtttttagcatgaagtgattttcaaatttatcaaaggccctttctgcatctattgagataattatgtggtttttgtcattggttctgtttatgtgatggattacatttattgatttgcatatgttgaaccacccttgcatcccagggatgaagccaacttgatcgtggtggataagctttttgatgcactgcaggattcggtttgccagtattttattgaggatttccgcatcaatgttcatcagggatattggcctgaaagtttttgttgttgttgtgtcttctgccaggttttggtatcaggatgattctggcctcacaaaatgagttagggaggattccctctttttctattgtttggaatagttttggaaggaatggtagcagctcctctttgtacctctggtagaacttggctgtgaatccgtctggtcctggggtttttttggtgggtaggctatcaatttctgcctcaatttcagaacttgttattggtctattcagggatacaacttcttcctggtttagtcttgggagggtgtaggtgtctaggaatttatccatttcttctagattttctagtttatttgtgtagaggtatttatagtattctctgatggtagtttatatttctgtggtatcagtggtgatatcccctttatcattttttattgtgtctatttgatttttctctcttttcttctttattagtctggctagcagtctatctgtttagttaatcttttcaaaaaccagctcctggattcattgattttttttaatgcattttttgtgtctctatctttttcagttctgctctgatcttagttatttcttgtgttctgctagcttttcagtttgtttgctcttgcttctgtagttcttttaattgtgatgttagtgtttcgattttgtatctttcccgctttctcctgtggacatttaatgctataaatttccctgcgaatactgctttagctgtgtcccagagattctggaattttgtgtctttgttctcattggtttcaaaggacttatttatttctgccttaattttgttatttacccagtagtcacccaggagcaggctgttcactttccatgtagttgtgtggttttgagtgagtttgttaatcctgagttctaatttgattgcactgtggtctgagagactgtttgttatgatttctgttattttgcatttgctgaggagtgttttggcagtacatatactaaaattggaacgatacagagaagattagcatggcccctgcccagtgcctttttttatgatactgttttaccaacaagagaagaccaattgtcctgtagaatgttacttcctagttttgtctgctttcttctttgtcatatatttcagctaattactctacttcttgtatgttttgtaaagtagaggttatatctaaaggctagatggattccagttaactatttgttggctggaacaaatcacatgtgatgttgtatacaccatatgctgcatcacatctgaagatgcataagattggttgattcaccttactgatgttaagattaaccattgctatatttttctaccctgtcaatgcagggctgagagtgtctgtacaatattttcagctagtccatatgtctttaatacatctaggcaatgataattcatttttaccttatgttatgctcattaacaaagcctttggtgttggttggagataatgttagctgaaacttacaggagcccctctgacttttacctgagtctttaaatactcattaatcacccctagagtatgcgtgtattcacaattagaatactacaattataactaatacgttatacatgttagagtatacatgaaaactaacaagcacataaaccaaatttcatcagttctaataacactttttctcaaattgtaatctgaattctgtacacatctgaaaatcaatggtttcttaaaattacacttatcaggcagcagttttgatgtaattatcatggcctccatatgcatgaacttgtaatagctgctcatattatagtcacttaagttaaattatgttcattgttgagtttattttctatttaaaatgtcttcaaaaatattacatgatgatatgacaatgaaattacttttctttcttagtggtacataaataatgtgctcgtaactgatgactgatgaaattcatgacatcgtatggactttgttgaagtatttaaagtaaatgacagataatataacaccagtggaggaagccaaagctgtcagccctttaaaaaaaggcaccatttcgctgggcacggtggctcacgcctgtaatcccagcactttggaaggccgaggcgggcggatcacgaggtcaggagattgagaccatcctggctaacatggtgaaaccccatctctactaaaagtacaaaaaattagccgggcatggtggcgggcacctgtagtcccagctactcgggaggctgaggcaggagaatggcatgaacccgggaggcggaggttgcagtgagccgagatcgcgccactgcactccagcctgggtgaccgagtgagactccatctcaaaaataaataaataaataaataaaaataaaaaataaaaaaaaggcaccatccttggggatagggacctgtttgcttgtgacactgattcactctcgccttcactattgtcttttccttttgaagaattttttattatgtaagatttcaagtatatatgaaaatagaagaaacagtatagggaagtattatgtgtccatcacccctccttcaactgtaatcaacacatggccaatcttgtttcatctatttccccacccatttcccctcctcccatgttattttgaatcaaatctaagacatcatattatttcatccacaaatatttcagtttgtcttgaaaagattagaactgtttataaacataacatcacatctaaaaagaaatgagtaataatgtaataatattatccattattctgtgttcagatttctgcttcctttttagttttgtgtttctggggtgtgtgtgtgtgtatgtgtgtgtgcgtgtgtgtgcgtgtatgtatgtatgtatagggtgggaaaggcaagcatacttaatagatggttctatgttcttctaacaggggacacacagtgtgtggttgtctttgcccccaattattttcgagagcactactttctgagattcacttaattgtcagagctggaagtccccttagatcacctaataacttcattttacagatgagggaacagatacctaaggatggaaaaagataggcccagagacacaatactttagtaaaagaaccaaaaaatattgaaggtagcttccttgtttaggagtcagagggcacacagttcttagaattgttggatgctaaagctgggcgagacctaaaagttcatacagatagcctctcattctgccagaggtctcagtctggcaatctgttgacaaggtccagaccagaaatatattttatttgtcctgcagtgttttgggaaaaaagtgatttggcttcaacatttaaaaaatccagatagttcacatcaaaatatacatttcaggaaaaaaagaggatgttagcacactggatctgcatgcccacgtggcagcaatcagttggggttgagtaatggtttcttgctttggaatgggcacaagcttctaatttgccatagccctcaccactcccaagtgttttaacaaatattatattagagttacattagatgtgacctaggaatttccctttcttaaaactagaagttattctgttgatggtgtgtctctaagtgagtggcgggaaaatggtggtctaaagaatgtctgcttgtttaaatgtggcagccacttctcaccaggcccatttctctcatgtaagttacctgccttgcccctctagacatttaaatttatgacctctaatctaaaccatgcaatcagaatcattttattctgtactggaggcttctcacaaccaacctcagtggactagagagttcaagattcctttgctgtcaaataacatcacatactcttgtttttggtttcattcatcttgttaacccacaatttggaatgttacttatcccccatactgattttcaaaatatataataaaaagagagacactaaatgcaaagcaatttccccaaagaataggtgaacttccaaatctcataagaaggccaagaaggaagagtatcctaaatgggatgccaagtaactccctcagagaatcagaaggtggctttagcttagaagagctcacatatgagttttgatttctccagaaaagttagacaagcaggcagtgggatgcaatgggataactataagacttggggagcaacaaatatgggcttgaatctctgccttgccatatgaccttgccaagtgctttgctcttggtaaacctaggcttcaaagctaaaatactctgctttttggagttgtgatgattctgtgagctgctgggacactgaacaaagatcagttcctttcaaagttcacaaaaggagatacacaagtgcccttgtggtttagccttttagggtcacttggtgttagcatggagatacttttccattttaatatctgaaaaaaacttccgtcactaaagaataaagattaattgcaggggtattgaaactgttaaaaggaacacatcaccagcccagcaatatcaaaagctatgaatggttgctgttcatttccatctgaatggtactcagctttgtctagggcttaacagacttcacattaagatttgtctaaggattctgtcctcctcaattacccactcagtgttaagaacctgccattctcttctgggccttagccttggtaggtgtggagagtgagtgtttcgggtagtcagttgggctgttcctacagccaaactgaccaaaagagattcttgccttttacttggctgcctccaggactgtttgaaacagcactagggagctcaattcctttacaaataattcattagtacctgctgtgtggcaggcacacacacttggaagttgtttatcatttagtaggagaggcagataagtaaacggaaaattgcaacttactctgcttgccagtggttttagttaagatgagcacagtgggctctggtctccctgaaggagatgtaacgttatgtgcatctccaaggatagatagacattttgtagatgtagggagaggggggatattccaggtagagagaacgacatgagcagagaggtatgggggtctgaaacaatgtggtataaccagacaaccccaatctaagcagtttagtataacaagagtgtcagaggtcagcagtacctgaaggctcctggagaggtaataataacaacagatacttcccagggtgccaggtaccatgctgaagcaatttatctttatttattcaacaactctctgaagtgggtgctattttcccaggtgggaaaactgaagttcagagaggttagagtgagtgaactcactgttgcgcagctggtaagtggccgtgttgggattcaaacccagcttcagagcctaagcagtgagtagggattggaaataggggtcaagttactcaagttatggaaggcctcatttgtcactttgaagagaattggccctatcccaaagtaggaagccactaaagggaatttaagcaatgaaagtgactagggatcagaaaatctgggattgcacgttctactctacagctaattgactgtgacttcgagcaaattcctttccttctttgggcctatgttttttcatctgtaaaataaggaagatgatcaagggcaagtcttaatgatccctttcagctctttcaggtttttgcttctctaacgggggtcaggaaggggctgatttaagagactagtaggcattctctcaatgtgctttgtggttctttgtacatgctttatacttatatgggctgttcctcttgctttgaatgtcctcttgcttccctcctgcctctccaaatagtatcccactagctttagtccctccccacatccctgtctgtctcttaattccttcaatgctgttagctaggttagctatgtctaaccactttgattcctaattttatactatcttgtattctttgctgattgtttcctttgtaatcttgccttccaatacatactttaggtgctcctttccttctacattttagtttctcttaccctctacagcacctaaaacagtcttggttgtaaggggatactggagcaaattttgttaatcttgccccttttcttctggcagtgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaaggtatgcattttctattctcactacctgtcttccaaacatgtgacactttcccccaactgccttttagtgctgtgtcttcctccttggctcacgttgacagtgaaaggaaatcccattatgacacaatgacatttaatggcaactctgaccctgggaaattcattcattcagcaaacattgcttaagcttataactatattattttcagacaccatgctaaatactgggggtaatgaagaagaaaaagtcactgtctgtgcctttaaggtgttaacaatgtgtagtatggagacagatgggtaaataggaaaatgatagtataaaagtagtctatatacaatgaaactgtaggggagaagatatttatgttctcacccattgctagtttcatggctgagatccctataacaaaagaccgattaacaagagaaaagcatacaaatttatttaataagttttacatgacacaagaacctttagaaatgaagacccaaagaagcaggtaaactcttgcattttttatactaagtttgatgaaatggatcgttgtgaagattagtgattagaagacagaaggatatgatctaatggtaataaacttagggggatcttagcaaggcttgtttgttcagattcttcttggtgtttctgtgtcttcgaggatagggatgttcttttccttcagttatagggagggtacctctggaatgacctacttcagaggaaggtcagagaattcttttatggcctgctccaggggagaaggtagagaaaccttcttgcttctgctgtttccacaaacgccaaagtgccatattttgggatagcaggtcctgaactccatcaaaactaaaaagaaatcaatgcttacacttattcgaaccccatctcattccaaaagtatatatggtagcatattttatattgcacataaaatataaggcatcatacattataatcaggtcaagtacaaaaggtaaaacaaaggtagagtcagaaaatgatgcccagaatgaggttaagacaaatatttattgacaaattcttgtacacttgcaacagatggccctgcacactggggtataagcttcatagcagctagtgccatcctagggaaaagcataattcaataaagaagcacagggaggcaaaagcagcaggacttggtgactggaagtcaccaaggatgggggagagggagatttctgaatcctgattttctgacttggctgactgggtggatggggctgtccttatacatataagaaattcagaatgggaaagtttgagggagatagaggaaagttcagtttggaacaggtcgcatttgagatttgtgaaagacatccagggagcaatgcctggcgagcagttgactatgtgaatctaaagcagggatcagaaagcttttccttaaaggaccgtataataaatacttaagcctttgcaggccatggatttctgtcacaactacttagctttgccattgtagtgagaaaacagccatagacaatatggaaacagatggttgtagatgtgttctagtaaaattctatttacaaaatgggaaacaggcctgtgggctgtaatttgctgacccctgttctagagcccagatgtgataaattgataaatcaattgattcatccaacaaatatgtgtcgagtacccactttatgccaggtactgtttcaggaactctagatatcatcttcatagagtttatatttagaaaaagtaaacaaatagtattcaaagtaagtaaagtatataatattttagattgtaatgaacattaaggagaaaagcagagaagggaaataggaagggttggaaagtggttttgcaattttaaatacagataggaaaggagaaaataaggaaatgaggagggcctcacagagaagatgacctttcagcagagatcgatagggagtagaggaatgattcattcacctatccagagagaaaggattctaggctgaggaaatggtaagtgcaaaatcccagaggcagaagtgtgcctgtcatattcacggtacaacaaggaggccagactagctagagtggattaagcaaaagatgaaatagaaaaagatgggctcgaagagataatggagagggacagactagatcctgtagtggagtcttataatccactggaagaattttagatttgctctgcctgggtaagatagaaggggggttttgagcatgggagtgacaggatttgatttaggcttaacaggcttattctggctgcaatgtggagaatatgaaggaagtcaaagaaaatctagataaattgagatacatactgtgttcatggagtggaagactcaacatgataaagatgtcaattctttaaaaattataagtttaaggtaatcaatatcaaaatcccagcaagagcttttgtagataaagacaagataatactaacatatatgtagaaatggaaaggaactgtaagggctaatacaattttgaaaaataataaactggaggtaggtattaataatattaatgcttactgtattgcttcagtagtcaagacagtgtacaattggcagaggtaacccgataagtcctcttgtctacttcttacataaacaaatagaacagaatagagaatccacaaatagccctacagagtatggcctgattatttttcatgaaggtacaaaagcatttcaagggagagagggtagtcatttcaatgaattgtattggagcaattgcagctctataggtaatgaaagtgaacctcaacctaaacctctcattttatataaaaatgagctcacaaaggatcatacatttacatataaatcataaaactaaaacttgtagaagataatatagaaaactgttagagcctaggacttattgaggagacatgataccaaaagcataatccattaaagaaaaaaaatcaataaattgacttcatcaaaattaaaaatttttgctctgtgaatgaccctattaataagatggaaaaaaaagctaccgagatttggagaaaatatttgcaaaccacgtatctgacaaaggattaatatctagactatacaaagaactctcaaagctcaacagcacaaaaattcaatctaattagaaagtgggcaaaagacatgaacatgacgtatgcgtggcaattaagtatatgaaaagatgttcaagatcactagccattagggaaatacaaattaagaccatgatgagagatctctacacacctattagaataggtaacgttaaaaaaatatatagtggcaataccaactgctgacaagggtacacaaaaactggatctctcacacatttctggtaggaatataaaatggggcggctgctctggaaaacagttttggagttccttaaaaactaaacatgcacttctatcggatccatcatttacactcctgggcatttatcccaaagaaatgaaaacatgtccacacaaaacctttatagggatgttaattaatatttgaaaaaaagttatttaaagcattttacacatattagcacatttacacctcatttcacataagaagaaaccaaggtacagagaagttaagtgacttgtccagggtcatggagtaagtaaatgttggagctcaaatttgaaatcaggcagttcaaatgtatactttaccacctctagatctttgttatgtgttttgcaaatgggtacctgaagtaagtgaaggtgagggtcattatagatgagagagctaaggaactttgaggcaagagttgctgaagggtcatccacatagtaaagatttttgatagaaaataattttctaatcctagcatttggtggtcagatcatgggtcttgtatgcttggctaaggagtttggtctttatcctgaaggcagtagggagccttggaagcatattctgaacattcattatatgatgattcattgcatcttaaatgtcctaattcatttataagtggataaaggagtgacacagcatctcatcattagtataacaaaataatttttcttttgtttttattctatgcatttttaggggcaaatgccaacttaaattttattagaaaatgtgttggttggcaaatgacctcaatcccaatctagttcataaaagtgtgattttgctatgtccaaagcatattatgtggcatgatttgaaaagcaattaaatgctagttatctcttattcccaggatataataggaggccatttctattaactagtggtcagctgttaagtgagattttcacaccgttgtaacctgttaatatgtgttaagtagtcgaagttctgacctttgtgtgataccagagatgtacgctgaccatgttttccaaacaaagacatggtaaccaaggatcttttctgatttatgaatttatttcaaatgaaacatcttacatggagatatgaaatgaaatcccagtttattaaatacttatcaagttaccttttttgaaaaatagcagaatgatatatgggtgagaatgttccagaaattctagaccttatgtaggtgtaacctcacatggtggttgtgggattaaaagagataatatgtgtgagagctgttgctgcttcacacatagggattatatgttcctggcaagttgttcagttaatggggtatgatttttcagttgaaatatattataatttcagtaatgtgttttttccatttacacttgctctttaatagaaaagggcttaaacacattggttttaagttttctttgttactcctttctttcagtctctcttttaagagcatccagggtctgtaaatacagtgtaagtgaatcagaagagttgatgcttaaaggagtctattactaagtcttgcttaaaatttttttttaacaacttgaatgatcttttctaatttttttcttttttaagttggaaagtaggtaaataataggggaagatctacctctacactgattccctagaacaacattgccaattattctgaagttctctctcttcccatctcacttagcagtatgtatcagggtgcctgaacctcatgttgttggcttgaggcatagaggtaatttggactgacagaggaaggttgacttctgttttccgaacattttgttttggggagctgccaggaattagtggggaagagagaggtcatctctgaaggcggttcttagcaatttagttttgaggacagagctatttcacctaaggggacaaaatatagggtagatccatttgaattttagaactggaaaggggccctaaagaccttcaggtccaagcttttcattttatatgaagcctcttttcgcatgccatggtagtggtaacaggtttgcatttctgcagctccattcctgcttgtctactgtttggaacatcagctctcccccacagttcttcccaactagtttataaaagaactcggataccagccacaaacttttaccagttgtctaacttgtgctttgcaaactcattttctcacctacacaacctggcatcagctgttttcctcctttattgctcccaagaccactctcaaagagctagaaagcagtggttctgcccctgtagacttagatttgtattcagtgaacatggaatcagtgtgggacagcgtatttccagctcgtttagtcctttttctaactctgtgaatgatggatcgtatttccatttctgagataggaaatggaggcattgagtgtagtaagtggcaaagctgagacttaagtttaggtctatcaggttaaggctgcccctcagggaaagggggacctgttttattgagatgtgagctgtgcttttctttgcatcattgatgatgacttagctattctagctactcttgagttccctccttatttccagtctttcctttttagtgggtgggcatctgctttttaatcatacaggaaggatcttgcctaactgtgttaagtatagttttctgggagaatagttgattatttttgagataattagaaaatctattatcggtgtatgtcaaaatggattttagtcttactgcttaagatatatggttcagggaaatggaagactgaatggtatagtcttttctgcagacatggatggttgaaggcagttcttcctataaactggccggagaaagctgggttattctcagtgtggagtttgtgggaactccagtgttgcctatgttcccaaatggccaaatgggacctcatccaggaaaaaagcccatgtcgtagcaatgtaatggatttgagaaggcaaacaagagaccctgttaagaaatggctctgatttatatacttttcagacacccagtctagcaacctagaggaaacagacccttccagtcctggtctgtctctcctttctctaaaaggtggtgtttgtgaatttcagtctgccaccagagggtagcaagagaacagatgaatgtgtccctccaactgatttctggaataagatagatagatagatattttaaaatataagtaaatgtaaatatatagttatactttatagattttactgtatagatttatattttatacatttgtattttagaatgtatctctatatctacctacctacacacacacacacacacacacacacacacacagacacacacacttggtggggggtgggcgtcagtatgtgtaaagagagagaatctaattaagccaagactctacttcacatttaatttctgaaatgataaggttaagctaaaggttattgaaaataacatttttattatctgtacatgtaaggatattttcattagtctctacatgtgaatctaatatgtatttagcttggaatttggcaaacattctcaattgaatctggagaaaaaatatctttaagtttgaatattaagatcaaaacgtaacctggagaaaaaatatctttgagcagagaattattaagattgggagatttcagatgtatttattagttacaatgaatctttgaaaacgtagcttcaagttttccaccttggctaagtggaggtctttcacacattcttcaaatgcccagttacttatagctttgaagtgaagtcaggccctgtttgaggtgaataagcatgtccaaacccaatgagatagggtgataaatgtaggatgcagttgtgatctgaggtttgctccaatgttcagagagcagaaaagattccccttttgattctgggaattatgccgatgattcagaatgaggtgaaaatatccactccttccctttttctctctctagctggggctgtaataataattatcacagtaaaaatgatagcattttttgacagcttgctatgtgtcagacatggtgctatacatttgacacaaagcatctcctcgatttctcacaactttatgtagtatttacttacaggtaaactgcggtctacagaggttaagtttctatggactatcaaaatcaaatatctgtttttattttctttttggaggcttcgagtgtgtgtgggtggggaagaatatagaatcagagatttttgagaatcgaaaatatctccaaggtcatattgtccattcccctcaatggccagcgattttcttgtatcatatattttttcctttgctgttctcctttgagtggcctgaggtctcaggttggaacaccagagtctagataatacagtaagactggggccagtgtgccagagggccagataggtgtactttggcagctagacttaaagcagactgagcttcagcagtctggtgataggccaataggaatttcagaaaacaggaatcaattgaggagcaatgagagatcgggtggactttttctttgctctgagatttggagagtgaaaactgggtcattgctactttcttagattaagactccttaccaagaactctgaaaatgtccaggctacctctgtgagctcttcagatatccctagagtgagaataatggaaagaatggaaaaatagctttaaactagacagcccaggggttacatcccaactttatcctttactagctgggtggtcatctaaacaagccagtttacccccctgagccttgtttccctcattaaaaaaaaatgataccaataattagacatacttcatagagtttttgggaggagtcattgagataaatgtttcaagtactttgtacatagtacattggccactaaattttagtacttgcccctgccctataccaccacccctttgctgtattgacaggagatgagctctgtctttgtggtggcattccctcctaatacttttattaataccttggtatctactaagtctttgtagtcaaaagaggcttttcttagtagctgttacaccattgtttatggttgttaaatgatagagaaactctttaatttcccaacctaaacgcatcttaagttgatctaaaaagaaactgcacttggaatctgccatctcattcttagtagaaaactcacaatccatgctgagtagatagagatgtccttaacaggatctgactttatcttctctcccccttgatattttcttcccaagacaactgggaaggggaatgaacagacaattagaacacggattacagaccggttagatataatcagtggaagtctacagctgtttcaggcaggaggtactggtttttaggggaaatgacacccgattgggcattagaactcttggattctagtctcagttctaccacctactagctttggggccttgggcaagtcacttccccctctttggacatcgattttcccataagtatattggatgagtaggactagacaggattctggaatgttacatctaaaaaggccttaaagactatgtgttgctgagaccaaagacagccttagtgacagcccttttataaaaagctggctcttggtaacaacagacgtgatactttcaaagttctctacatactctaagcaaactcggtgacacacttgatgtttaatgtggtctgtgccaaatgctaagagctcattacttttgaccctttgccacctttgtttctagtgtagttaagagtatggtttttgctaatataaccagaacccagaaagctcaacatagccttagccagagtgtaaatggagactcagttggaaagctgggattcatcagggccaagtcttgtagctttgatttatagaaaggcaaaatgtttttttgtacaatctgatatttgcagccctgaagcgacatctggaaagaatctggatagttgctcatttctgccaagatttccaagagttagaatgggtctggatctcttggcctttggcaattggaaatgaccatcttatattaaatttcttctctctttcacacctaaagacatgacagagaagaatccgtaagggggttaatatgtgaccaaactcaggcaagcagttcattaaccctcttcccaatggaggtgatcgctctcctggcagtgtctcaaagcccagcaaattatccagatttagttcccagaagccttcaggagagggattccaggagttgggctccttcctgaatacaacccaaaacaacagccaaggcccatcagaatgaaataatattcctcggatattgagttctcttagaccaggcctttagaatggcactcagtgccaaccatatgcccagaaaacaaataagcactggtttgcccccagactctactttggccaccttctgggatttttttctgaagtcactatcagagaccatgaagccctaattgttcttaaccagtccacagaaagccaaatcagtctgtcctttttctggagttttggagggtgggaaaataagttctgcctgatactgtttctacccgaggagttatttttaaacttaaaatgtttccttctatggtttatagtggaaagagtgttagccttgaagtcagacacttctgagttcatatcatagccctgcttcttactatcaggtggccttggacaatgcacattctttattcccagccaagcctttggcctcacatcctctttctagtcttctccccagtgagttgatctagtctgtctatgagttaggaattcctacttaatttttcagctacagaagaaccactacagtgtccagaggagggaaaatgaaggcctataccctgtcaagttctagtgataattttctcaactttccattcattcagctttctaattattctttcctcccttaatcctgtggaaaggggtagatagagggatttattttgtggttaccctaatgcgctagttgttcaatcatgtccttcaagcccaggttgtctttgcagagaaaggaatttgtgttcagagaaaggaacttgtaaacactcaataaatgagttaatatacataaaacacttagacatgtgcctgacatgtagtaaacattgtagaagagttgaccattaaaactaactctgacccatggcttgaacttggaaaaagtttattccatcaaagccattttagtcagtcttctgggtcagcagctagtaccaccatttccaccttctattactgctgtcactaccttttcacaatgattgcatgagatgcataggaactggttttgcatcctgtgccacctagtatttgaccctttagaaagtctccatatgctatgagtttcccattcttttaggatttatttctgcttttttttttttggagacagagtctccacttctgccacccagtttggagtgcagtggcgtgatctaagctcactgcagtctccatctcccaggtttaagcgattctcctgcctcagcctcccaagtagccaggattatgggtgtgcaccaccactcccggctaatttttgtatttttggtagagacagggtttcaccatgttggccaagctcgtcttgaactcccgacctcatgtgatcctcctgcctcagcctcccaaagtgctggggttacaggcttgagccaccatgcctggttttatttctgctattgtaaaagggtaggttgttattccattctcagaacctgcttagaataagtcctttcatggatacacaagaagccactggggcattaggtagagcttgctaggtttcttttcttggacctattctaactcccttgtcagctctgaaagttttctcattaatattggactgccaacagtgagttaagagatcttgggcccatattctctttccttcctcctttcttaatagaaactgtggagttttccgcaagttgcccttcccaattccactagttatatctgtagtttataatcctgtttttaaggtaccaatgtcaccccttcattcaatgaatacttactaaatgcttactatggacaggtgaagttctaggctctggggatacaaacaaaacaaaggcccttttttgtgggtcttatgttctgctggagataaacaatacatcaggtggtggcaagtgctctgaagaaaaagtaaagcaaggtagtgggttgttcctttatggaagatggtcagacaaggctactgttaatgtgttatttaggcagagaactgaataaagtaagggtacaaagtatggtagatatctttgggaagagcaattccatgaatagggaaaacctagtagaaaggcccaaggcagcagtgtgcttggcatgttgaacagcaaagaaaccagagtgtctgggagcaaggatgacaatctgctccatttctcttcccaaaaggaatagcagtaacacacaggttaatgcccattgttaaaaaagagttttgaagtgaggcctttggagggccacagaccagaaaaagaggtaagtggattcttcttactacagcaattgccaatatttccacattaaagtttggcttgaatgtttgcatctgtaggccagctttgggaaggatgttgcaatccgtgatgactgcagggttattcaggccacattttaattttagagaagacacacaacaggaagtttcccctttgcttttctagacttttctcacttaaagagagtgtggttttaagcctaccaagcaccttctctgagctctgcctactgccacattggcaaaactgctctcaaccagctccttaccaatgagcctttcagtatattttcaggagacagggcatgtggacaacaccctgtccaggtggaattgtcagctctcattataaatcgtagaagtcagtgagcccatatctatcttaaggcctgggtagcttcttgaagaagaacaacctgtgaggaagggttttttttttcaatgagaagtgaataatttttataactggagcagggaaataagatcatttaatctgacagagagcttgaagagcaattaagttcatatcacctgatttgcatagcatgtaactgcttcactccctattgctccggtctgaaaatttctctgttcctccctccctttctctaccactctcctctccctctccctgtccccctctttcactctctctccctccgttccctccgttcctccctctccccccgttcctccctctcccctctctccctcccccctccccacctctttgtgtgtcttgtgttttctctttctctaaggaaacataggtttaagttctttttagggttcatgataattgcaataactaccacttactgagtgctcagtatgttccaggctaggttctttacatcaggtataccttgctttattgtgctttactttattgctctttgcaaatattttatttttaaaaacaatttgaatgttggtggcaatcctgtttcaagcaagtctatcagagccatttgtccaacagcatgggctcacttcttgtctctgtgttacattaggaaaattcttgcagtatttcaaacttttttttctttcttacatctgttgtggtgatatgcgttcagtgatctttgatgttactatgtaattgttttgcggctccatgaactacacccagacaagatagcaaacttaataagtaaatgttgtatgttctgactgctccgccgatcagccattcctcatccctctccctctcatgcttccctattccctgagacacaacaatattggaattaggccaattaaaaacccgacaaaggcctctaagtatgcaagtgaaagaaggagttgcatgtctctcatgttaactcaaaagctagaaatgattaagcttagttaggaaggcatgttgaaagctgagataggctgaaagctaggcctcttgtgccaaacagttagccaagttgtaaatacaaaggaaaaattcttgaagaaaattaaaagtgctactccagtgaacacacaaatgataagaaaccaaaatagccttattgctcatagggagaaacttttagtggtctggatagaaaatcaaaccagccacaacattcccttaagccaaagcctaatccacaggaaggttgtaactcttcaatctgtgaaggctgaggaagtaaggaagctgcaaaagaaaagtttgaaactagcagaggttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagaaactagcagaggttggttcatgatgtttaaggaaataaaccagttccatgacataaaagtgcaaggtgaagcgacaagtgctgatgtaaaagctgtaccaagttatccagaaaatgcagctaagatcattgatgaaggtggcaacactaaaaaacacattttcagtgtacatgaaatagccttctgttggaagaagatgccatgtaggactttcatagctgcaaagaagtcaatgcctgggttcaaagtttcacaggacaggctgactcttttcattaaggactaatgcagctggtgaagccaaggctcattgaccattctgtaaatcctagggcccttaagaattatgcaaaatctactctgcccatgctccatatgtggaacaacaaagcctaagtgacaacacatctgtctacagaatgttttactgaatattttaagcccactcttgagacctactgctcaaaagaaaagctctctttcaaaatatcactgcccattaacaatgtagtaatcacccagcagctctgatggagatgtgcaaggagattaatgaatgttgtttccatgcctactaatacaacatccattctgcagcccatggatcaaggaataaagtaactttccagtcttattatttaagaagtagatttcatcaggatttagatcccatagatagtgattcctctgatgaatctgggcaaagtaaatttaaaaccttctggaaagcattcaccaatctagatgtcattaagaatattaataatttatgagaggaggtcaaaatatcaacaaaataacagaggtttgaaaaagttaattacaaccttcatggctgactttgaggagcttaacccttcagtggaggaagtaactgtagatgtggtagaaatagcaagagaactagaattagaagtggagcctgaagacgtgactgaattgctgccatatgaggataaaagttcaatggatgagaagttactttttatggatgagcaaagaaaatggtttcttgaggtggaatctactcctggtgaagatgctgtgaacattgtggaaatgataaccaaggatttagaatattgcataaacttggtttactaaagcagtggccgggtttgagaggagtgactccaattttgaaagaagttctgagggtaaaatgctatcaaacagcatggcatgctacagagaaatttttttttgtgaaaggaagagtcaattgatgcagctaacttcattgttgtcttcttttaagaaattgccatagccactccagccttcagtaagcaccatcctgatcaatcagcagtcatcaacatagaagcaagaccctccaccagcaaaaaagggtatgatttgccaaaggctctggtgattgtcagcattttttagcaataaattatttttaatgaagggatgtataccttatttttaggaatcatgctattgcacacttactagactacagtatagtataagcaccatgaaaccagaaaaaattgtgtggctcagtttattgtgatacatattttattctggtggtctggaaccaaatccacactatctcctaggtatgtctgtatgttacctcattcaaccatcacaacaaccctatgaggtagatggtatcactattctcattttgcagctgacattttcaaaatgcaaactgagcttcaagtttgagattcatatagtttaagtttcttgcccctggttacatagcaaagctccaacacaactgactctgactctgtcctgactctttgacctctactttgtactctctcacctctattttgtactctctcttcccaattatagttggtgaaggaataaatgaaaaaaaaagttctattatttaatatgctctaaagggcctggtagccaaaattcatccattcattttaaaaactgtcattgagctgctttatcttgcctcgtgccctactcagccctagtctctagagaggaatcacgaaaaaaaatctctgctgtcagaaaagttatgggacttgggggtatctggaaccaactaacactcaggatgcagtgtaataaagactgtggtgaagatgtgcattggatgctgtgggagcccatggaaagggaacttacctctctattgggaatcagagaagtcttcatacagtgggtaatgcatgatgtgagtcctgaaaatcagaggagtagattaattgattaaccttctgtaagaaaagtcctcctataacagaggactgcaaattatttggcttaaatatgatggagaggagttcatttttctctcacataaaagtctagcagtgaatagtccaagatcaatgacatacttctgccatcctcaccacttggcttcagtttcttgatcctagatagctattccatttgtccccatttactagccagagagaaagggaaaaaaagacagaatgtaatacagacagcttcttcataaaagcatgacccagaggctttcatgcattatttctacttgtattctgttatctaaaacttaatcacatgtccttacctagctgcaagggagactaagaaaggtaggcatgggtgcccagctaccattcagtgacttccattagtaaaagtaagaaggggaaggtgggtaccagtaagcaattagcagtctcttccataaagggtaagagtgaaagtgttctgtgtatagatcactctggatacatacaggaatgagacaccagagaaattaagttccataaaataaccaaagaactaaataactaagagactaaagaactttaataattcagcatggctatagtggagggtgaatgtaggggaatagtggaagatggggaagatggggctggagatttcaggatgtggccagattattgagtactttgtgtgctaactaaggaatttggcctttgtcccgaagacagtgaagagtcattgaaacattttaagcagtggagtaacacaattagattagagttgagaaagatcactctacctgcacttgggtagacagattaaagacaggagtggctggagacagaaggaacaattaggagactattataatcatagagagacatgatgagactcaaccaagtcagtggtagtgagcagaggggacagattagagagacattaaggaagtataattgatagaacttggtgactaaatggatgtgggatgtgagagagggggaggattttaagataataatgtccagatttgtggcttggacattggcattgttttagataataaaaaattttaagggacgaaagtgtttaattctagaaatgttgaatttgagatacctctgggatatccagaaggcaacattgagcagttagttagatatattggtatagaaaccagtagagaaacttggtagtgcaagccatgtgagtggatgacacggttgagaaagcgaatgagtgcagacaagtgagatcattagaaggttgaggacataatcctggagaacattaaatttcagagagagccagtgaaagagacgacagtgttcagagaagcagaaaggtaaagagagaggaatttttagaaatggattggttaaatgtgttaaatgttggagcacagtcaaaataaaaattgaaaaagtacctgttggagtcagcaatcagcaggccagtggtgatcattgtaaaaacagttacagaggagtgatgtgggcagagacaaggttgaggatcaactggaggatgaagaaatggagacttaactgtctggaaagtgtagaagaaaatgaatgtgatggcagtggagagtagcttgggttcagacaggagagacttaagttcatttaaatgcttttgagaaacagtattgtaagaaaggagatgaatgatggaggaaggtccctgagaaacaggaagagatgagatgggatccagagcataggtagaggcattctccttagaaagtgaggagagataaagtaggtttataagtgtggatgtcaatgagtttgtcagtatggggacagaaagttgaagttgtttactttatttatttatttatttatttatttatttatttatttattttgagacagtcttgctctgttgtccaggatggagtgcagtggtgcaatctgggctcactgcaacctccaccttccagatttgagcaattctcctgcctcagcctcctgagtagctgagattacaggcatgctgcaacatgcctgactaatttttgtactattaatagagctagggtttcaccatgttggccaggcttgtcttgaactcctggcctcaagggatccgcctgcctcagcctcccaaagtgctgagattacagacatgagccaccgcgcccagctgaagaagtttacttctaatgacctcccttttctctgaagtatgaggtgacgccatctgtgagggagggtgtctatggtctggtatattatgaatggctcagcaaggatgtcttctaactgagcaaagggaaataatatatgatgcgtttatctccattaataacactcacttgggttcaatcggaagagattgttggatggacagatgcatggatggatgcctataaacataataaatatgtattctgttttcctccactcaatgttttcaaaacgtttttttagaagtttagttcagggttaaaattttcttgaatcccatctgcattaagtaagtatattctcatttgttattcctcttcattattctagaccaacatttttcagccttggtattattttgacattttgggccaataattcttgttgtggggactgccctgggcattgttggatgtttagcaggattccttgcctttccccactagatgccaaccccccttccacagttgtgacaataaatattttcacagatgtcatgaaatgtcccctggaaaatagaattggccccatttaagaggttgtattcaaaaccaaatggaagggccctggagagagagagagagaagggggatttaagctagacaaatactcatgtacatttatcagttgatcatgacaactatactcatagacatgatcttcttttggcaaattagacaactgaggctcagagaggttaaatgacttgcctaacatgacagaggccataagtgatagagctggggtttgaactcatgtgtgttagatccctacaatttaggttctttcttaagcaacaataaaaaatattttagagggtgtccttgttttcatttttattatgttttaaaaaatcaaactaaacttaaaattcagcacaaaaatttaaataatatagaagtgtatagactaaaacaggaatgtatctgttgacattcctctgtaatcctattcactttcctagaggttatgattgtgattgttaacaatttaatgtgtatgcttttagacccttttctttgcaattataaatgacaaaggacagtgcattcatacacacacaaaactatttttgaataatgacatcatactatatatactattccataagctactttaaaatatttaatctttccacctcagttcttacaaatctacatcaccaccttttaacagttgtgtaatattcctcagtgagtgaaccacaatttatgtaactttcccatgttaatagatatttatgtagttttattttttttatggtacatggaacttgcatagatatcagtgtgtgtatgtgtcaggatttctgcttaataggggttttaaaagtagggagatcagaggtcttgcctatttaaaatcatgattgctactaccagattgacccccaatatggataaaccaaatcatcctcccaataacagcttataaaggtgactgtttttacccacttctttgtcagtttaggacaatatcgatttttcttaatttatcagtctaataggcaaaatgtgatatcttgtttgaattgtagttttataattattagtgaagttgatttttatgttcacaagctatttcattttcttttcctttgtatgtccttttcagtggctggtcgcttcaaaatcctcccctctccaggccactcccacactaaactcttcacctaaggcaaccactaatcagttctgttagtataatttgtgtttcctaaagttttgtataaacggaataatgcagtatatacttttcttttggtctggcttctttggttcagcatagttattctgagattaatttaagttgttatagtgagtcaatagttcattcctttttagtactgagtagtattccatcatatataccaaaatttggttgtctattcactagttaatggacatttgggttgtttcagtttgggtctgctgcaaacatttgtgtacagtctgtacgactatatgttttcttttttcttgagtaaacatgaaggagtagaaatgactgagtcacatagtaattatacatttaatttttaaagaaaacgtaaaacatttttcttaagtaactgtatcattgtactttctggaagagactgtaaaactcatgttaattctgtatatgtttggtggaatcctccagctaaactctctgggtctagagatttcttctttggaagtttttaaactatgaattgaaattttttaatggttataggactattcagatgatctatttcattgggtggtttttttttttaattcactatgacattgtatgattttacattcccatcagcagtgaaagttccagttcctccatattcttttcaacatgtggtatggtcagtctaaaaaatttcaaccattctaataggtgttcagtggcatcgcatcatgtttttagcatgcatttccctattgacttaatgatgttgaactttttttatgtttgccatttgtatgttttctttggtaaagtgtctattcaaatattttgcttattctttaaaaactgatttacttgttttcttattattgagttattgagttttgggagttctttatataatatatatataatacaagttctttatcagacatatgatttacaaatattttaactcagtctgtggtttttcttttcattcttaacagtgtcttttagaaaatcatgagttttcaaatttgatgttcagtttattgattattttatgaatcattgtatctaagatatctttggctaacctaagattacaaagatttttctcctcgaaattttatagtttcagcttttaaatttgattatagcccattctgagttagttttcttctgtggtataagatacgaattgaagttttttttttttttttttttttgcctatgtatatcacattgttccagtaccattgctgtcctttctccactgaattgcctttgtaaaataaataaataaatttatctgtatagatgtgggtctatttctgggctttctattttgttccattgatctattcacctatcttgacatcagtgccacactgtcttaattgttgtagctttataataagacttgaaatcaggtagtgttagctttccaactttgtttttctttttcaagattgttttggctattctaggttctttgcatgtccttatacatttttgaatcagcttgtcaatgtctacatacaagcttactggtatttgggttgtgttcagtctgtagatcaattttgtgagaatttacatcttaacactattgagtctttatacctgcaaacaaaatatatctcagtttatctagattttcttaatatttctcagcaatattttgaagattttagtgtacaaaatctctctggcactttgccttgcaaattctcacttccttgtctttcccatactcccaattcagtcttctcaacgtagggatactactgggttccacttgggttccccttcctgcactgcagcctgcaaaactctaagctgggaaactcatagggctgacctcatttgtttttttcagtctctcagcattcactgtccttcactgctggatttccaatgcctttaaaactactgttgcatgtatttttcctagttttgttttgtttttacttgtttcaggctaaatgagtaaaactagtttctgtgccctatcttggccggaataagatagtagctgtttgtagtagtattttagtagtagtagttagtagctgttaatagtagtagtattttcaggtgacagtttggccttttacattagaattgcaaatgtatttgttttttgcctcagcaattccagtccctcttctaggtggtggagatagagcagtgaacatgacagacatgcttctatgttgtgtaaaatctagcttggagacagacagcaaacaaaatcaataagtaaaacgtgttatatgttagaaagtgataggaaatgctgaagagaaaaaaaattaaaatggaaggaagataggaatgcttgcgtagagggaggcatgtcattgttttaaatatattgacctggaagggcttactgagcagagtatgtttgattagaatcctagaagaatggatatctgaaggaagatcagtctgggtggaagaaacagtcagtgcaacgacctcatgtattcgaaaaatagcaaggaatatttgtaacaactactacagtgtttgagctcacaaaatggtggctctttagactattattactaatgatggtggaattaggaatatgacctagaaccgtatggcctcaacattaatctgcttgctgttaagttacattttgtcttccttacaatcatgaggcatatactcacggtttgtgattgttcatgcattgtttcttatcattgtccaccttttacacagcttgccttgtgttctcaatcatgttatttccatgcccatgtagtctgtgttgacccttgcctgatgggatattgggctctgacatttctctttacactaatcactggggttgattttgttagtctcactggctagacagtggtctcctttctccatcacatatgtgtatcatcccatagtgtatgcacttgggctaaaaggttggtctccatggagactggaaaatccttaagtacacatgagacattatataaaaattctaatcacagctccttctgcatgccttcggcacttcttatagcatccaaggcactgtgttgttgctttttaattttattttactttttattgaatagataatgtaccatggcatgaaattataaaagaacaaagtgacataggagggaaaacacagttgttctccctgtattccccagccaatcattagtcctaccttgagacaaacaatgtaatcagattctttggtatcccttcagaactatttaaggcatatgggcatgtaattgtgtttagtctccttccatgtcctacccccacccatagaaggcaccttgacagctcctttaatttctttcttaccacactctgtgaagtgggtgatgctgtccctatgttacggatgagaaagccaaggctcagagaagtgaggtgacttgcctaaggtctcccaggaaggacatggaaaatccaggactaatgccatcttttataggcattttttcttccaaactgagaagtgccaggttctgtgccttgagcatagtaggagatacctaaacatttacctgtagctagagtgattaagaaaatctctgattctttgagtcatgttagtattcacgttacaaactctagatataaggccaacaagcatcaactggtgggtagcattcagaagacaaaaacttgatctaattattctctagatatcttccttctttctccacagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaaggtcagtactgaggttcacctttagcttctgaatggtgattagacacaaagaggatatcgaagggcagaagcggtggcatgaccatttttctctctataaaagtagacctttcctggctcctgagcttaaaagcagccagggtttgtagtttgtgctcagagaggggattaagcctttgacagcagataggatggtgatgagcttgtaaaggaagttaccacgtggaggatccctataaggccagtgcaggatccaaggtgttcttagatttatgcccccaatatattgaaatgggtgagcaaggtgaatgttgtgaaattttaaattcaaatatagcaaacacggattggataactactatgtgccaggtactgtgctaggtgaaattaagatacattgcttgccctcacagaagaaatggagacatagataagtgaagaaataaatgccttcagtggaataattgctagtgtggagactacacccattctaaatgtgcctctgccctcctactccactaagaccatttttgtcaggtttgccaataatctccatgaggccaaaccaaatagctacaacattgttctcatcatactcagtttgtgagtagcatctgacacagttgactaactcctccttcttgaaacactttattcacctggctctcaggataccagattttcctttaatctcaccagataatccatctcagtcttctctcctggttttccttctcttcccaactttacatgttagaaggtcccagagcttttttcttagtcctgttctctgatcatgttcttttcctgtgtgatctcattaaatttcatggttttacatatcatttaaatgctaaagatgatttccaaatttatctaagattgatatcttgcctcttttgtcatatcaaatttcctgctcaacagttctccttggatgactcatgggcatctcagtttacactgtgcaaaacataacttgatgcctgactctttcttaacctgctcctactctggtctcctccatctaagtaattggcagcagcagtcatccagttgctaaggtcaagaactttggaatcatccttggttactactttccctttttccttcatattgaatccattggcaattcttgtcagctctacctgcacattatatgctaacttctactactgcccactgcttctatcactgtaagccactattatctcttacctggtatcattgcttgccttcttccttgcctgtaattcattctccccggcagccagtaacagcacatcctttaaaatatggaaatcaggattctgcaagcttcccaagcacacatcagcagccggctcccttactgtctgaatcatcgacctctctccatttccaaaatgtcgctttctaacaagctgacattggacaaaccagacgtcaaagggcagcgggtcattatgagagtggacttcaatgttcctgtgtagaataaccagataacaaacaaccagaggattaaggctactgtcttaagcatcaaattctgcttggacaatggagccaagtcagtagtccttatgagccacctaggccagcctgatggtgtccctatgcctgacaatactccttagagccatttgctgtagaattcaaatctctgctgggcaaggatgttctgttcttgaaagactgtgtaggcccagaagtggagaaagcctgtgccaacccagctgctgggtctgtcatcctgctggagaacctccactttcatgtggaagaagaagggaagggaaaactctgggaacaaggttaaagtgagcccgccaaaatagaagctttccgagcttcactttccaagctagggaatgtgcatgtcaatggtgcttttggcactgctcacagagcccacagctccatggtaggagtcagtctgccacagaaggctggtggttttttgatgaagaaggagctgaactactttgtgaaggtcttggagagcccatagcgacccttcctggccattctgggtggagctaaatttgcagacaagatccacctgatcaataatatgctggacaaagtcaatgagatgattattggtggtggaacggcttttaccttccttaaggtgctcaacaacatggagactggcacttctctgtttgatgaagagggagccaagattgtcaaagacctaatgtcccaagctgagaagaatggtgtgaagattaccttgcctattgactttgtcactgctgagaaatttgatgagaatgccaagactggccaagccactgtggcttctggcatacctgctggctgaatgggcttggactgtggtcctgaaagcagcaagaagtatgctgagactgtcacttgggctaagcagattgtgtggaatggtcctgtggggggtatttgaatgggaagcttttgcccagggaaccaaagccctcatggatgaggtggtgaaagccacttctaggggctgcattaccatcataggtggtggaaacactgccacttgctgtgccaaatggaacacagaggataaaatcagacatgtgagcactacgggtggtgccagtttagagctcctggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgttaaaaaaaaagtgagctgtgttagcttagttctcttttgatgtagcttatcctgattagctttgtcactgtttcactactcagcgtggaaacaagatgaaattccatttgtaggtagggagacgaaattgatgatccattaaatagacaataaaagtgtccattgaaaccatgaaaaaaatggaaatcagatcacatcattccctctgtgccaaattttcagtaacctcccttcatacctagaataaaatttgcattttattcttcattatatgactgttgcttatttctgtgaccttcatttctgaactttgctctctcactgtctcttttgctctctactgtaatctcattgttcttgcaggtccttacttgtgtcaaacttacctaagggcctttgcatttgctactctcttggccctaaacattcttcctccagaacttcacaaggctcactctttcattcaggtgtctactaaatgctttcttctcatagagaccttttcttaacattctacttaaatagttctttctcctcctccaatcactccctatccctttatatggcttaatgcaactcatatcccctgcttctgtttgttcacatgtttattatctctctctcccattagaatgtaaaatctatttgattaccaggccctagaacaactcctggtatacatatcatgtatttagtaaatattctaagaatgaatgagtggatgtataaggaatgatgaagagattatcacttaggttaagggatcaactctttgacagaggaggtgagctggcattcaggagaaagtggaggggaacattggatgcctgtctgttgttccatagtctcatttttacagaatgggtttgtttatttacagtctccccaaatataaactctatgccagtggccacttgttttttttactatatccaaagcatgggcacagtgccaggcatatagtaattccttaataaatgagtgcaaaaaatgaatgaactgtgtgtcagtagatagaaggtctaatttaatcttggctactagcctgctgaataacttgagctagtcacttcccctctctggacctcaatttgcccctctgtggtgatgagggctttgggacagaagatctccaatgaggttacccagtctagacattttttatttttaacttttttaaaaactgagctataattcacataccataaaatgcaccattttaaagcgtacagtttaatggtttttagtaaattttgtgcaactatcttattccagaacatattcatcatcccagaatcccaatacttttaaatttacttctcccccaacctctgacagttactgatctactttctgcctctacggatttgcctattctgaacatttcatagaaatataattatagaatatgtggacatttttgggtggcgtcttactcttagcataatattttcaaggttcatccacattgtagaatgtatcagtacttcattctttcttatggacaaataatattcctttgtatagatgtagcacattttatttatccattgatcagttgatggacacttggattgtattcattttttggttattataaataatgccgctgtgaacattcatgcacaggattttgtgtggatgtctgtttttaattatcttgggtatatacctaggactggaattgtaggttatatggtcggtctatattaaaacttttgaagaattgccaggctgttttccaaagcagctgtacctttttttttttttttttttttttgagatggagtctcacagtgtcgcctgggctggagtgcaatggcgcgatctcagctcactgcaacctccgcctgccaggttcatgtgattctcctgcctcagcctcccgagtagctgggattacaggtgcataccaccacaccaggctaattttttgtatttttagtagagatggggtttcactgtgttggccagactggtctcaaactcctgacctcatgattcgcccacctcggcctcccaaagtgctgggattacaggcatgagccactgcaccaggcctcagctgcaccattttactttcccaccagcaatgaatgaaggctccaatttcaccacatcctcaccaatactttgtatagtctgtcttatttattctagccatcctatgtgagtgtgaatccataatctcatttaatgttcagcactcccatgcgaggtaggtatgctgaattctgttttatagtgaaggcactggaagctcaaagatgatgagtagttttcccaactaacacagctactaaatgacagaacaatttgcactcatctatcttatcctaaagcttatttatttactataatatcacacttcctataacctgtctgaacactgttctgagaaggaaccaatcctgctcaccagtagcatctcattatctcactctgaaatttgatatcccttttgtatatagtatgtcagtgactcctttcaccctcgtcatggactccatcacacctccataactaagccctgattattccacttctttaacctctcttgaatctgcctctcttttctgacgcagctctagtttggatccttctcaacagcggtcccctagcttgtctttctgccaccagtctttctggtccaagctacttttcattggaacgagcctatttttcattacttttcgtaatgaacccaaagggatgtttaaaaatgcatatttgataatgccacttctccccacccacagccctctgccccccaaaatcattgtcttctgtgactcaaaggcagagtttgtattcctgagcatggcattcatggacttcatgatatagccccaacttattgcaacaacctcacctccagctacccacactttttcatctgtaattggtccctatgctcaagccaaaccaaacttttaattatattttcttaggcaaagcatggtctttcactcctccaagttgttttttgtttgaatgccctttctactttgctccaccttttggaattcttcaaggcccagcttaaaagttacctgttttataaagaccctctctaatccttgcagtcagtattagtactgtcttactcctagcacttatttgcatgaatctacatgtattataataattgatttatttctattactgtaccagtgtgtatcctctcaaagcttctccccacctcttacccacccatggaagagaggcctccactttaagggttggccccacgcctatttatgaggcctccctgtctcatcctgattcactcccagttcttcgtagtccctgagacttgtctgtgtgttttcctgtagaaatgggtggctggttagggaaaggggatggcaccgaacttttattacctgacagagcaatgaactctcttcagaaagagtaagtagactctggaagcagacttcaagatttgaaatttggcgtttccacttagtagttttgtgacatggagactgcgggtgtcttagattccttatctgtaaaatggggctagtaacaatgtactactttatagagctgttttgaggattacatgagataatccaggtaaagcacttagaacagggtctgccatggtataagtgctcaagtaatggtatgtgttgtctttatcagtattattctcattattactgtcattgtcactattatcattatttttattcaccataccccagaacctagaaatagtttccctgctgaaaggcctggctccgaagtcatcatggcttctatcattacatttcctattttcccgagccagcagaagatactttcctgagtggaaggtagcagcctctctgaggctgtgtatgtgggtcctctttatgaagattggctctcttgagatggtgatgttactctatggcctgtagggcacaggcaacctttatttccctaagggagagcagagatggagtcacttgtccagaagaaagtattcagataggaacatgcagctgagatgttgggctaaagcatgtgagggaaagaatttatgtcaccatgcactttattgtttggagagagtagatgtgcttgagttactcctgagtgctgtgtttaaagatggcctctgccacaaggcacgtcctggaagccagaggctctagttatttggcgctcttgtgctcatgttcatgccattatttgtgagcctttggtagttttttgtttgatggcctctgtctggttgcacttatgctagggttaataaataaagggctatgtgtctactttgggacaaaattagggagactataggggaactccccttggttccggcccctttggcagtggcatcagtggtggcaaattcccaaggagaataaaactgtctaggggacaaaaacctttgcagcaagacttcccccatggaaacttttgcctcactgcccacccaccacataatagtgtaaataataaccaccaattaatgagtgtctgttatgtgccaggcactgaaataagtatacctaccatctcctgtaatcctcaccataacctcatgagaccggtattctttattattcccgttttactgaggagaaaatttgaggtacagagagaatagggaacttgtacgaggtctcacagtcggtaagaagcagaactgagattcagacctggccacctggcttcagagcctgcatttcttttaacattttattgcgaagaattccaaacataaacagaaattggaaacaaacgtattgaactccccacatttcagcatttaaaaacatatatcaagtcttatttcatctatacccctacccgttcccccaacctactcatcatgtcatttcatttgtaaatgtttcagtgtatatctctaaaagaaaggaactcttttaaaagcaaaaccgcaatatcatcatcatacttaaaataaaacaaaacagtgattccttaagatcagctatccagtcagtatccacattctcctattatctcattttgttaaaaaaaatatcaagatctaaataagatccatgtattgcaattggttgatatatatctcaggtttcaatttgctggccggaacctctgttctttttttttattattattatactttaagttctagggtacatgtgcacaacgtgcaggtttgttacatatgtatacatgtgccatgttggtgtgctgcacccattaactcatcatttacattaggtatatctcctaatgctttccctcccccctccgcccacctcacaacaggccctggtgtgtgatgttccccttcgtgtgtccaagtgttctcattggaacctctgttcttaaccactgcactcgaagttttttatgactatggaaggtgacaatttctttacagcaggcattctcaatctggggtttattgacagcttcagaaggctctgtgaatcactaaaaaattagttttcaaaatttttgctatatttgtgtgggttaatttttctagagagatggtccctaggtctcattagggtctcaaaagctttaagtaagtctcagaaccactgaaagacatgtactaatgtcagaggaaattgtagaccacaaaagctggggaaagaacagttggaggtttccttccgggttggagaacgaagttaaagtatgttatgttgattaacttaaaatttgagagaccttaacaaaatacttttcagagaagtggttaagaattaactgatgatgtcttcatttgcaaagaatagaatatgccattgactggggactttaagtcttttttgagtgacatattcctttaataaaacctcttggtttactgtggcttattgaattgtggtggtgaaaatcatacgcggatcttgaattccctatttggattggatctgtggctttacatgaactgggaagggtagagaatgattttgtgggatatagttggtttgtgccacagtgacataactgctttgaaaatgtatacaaattttcaaaattaagtatgtatgcatgtatcaaaatgaaaaggttttaaaagttatcattaatcttccctcttggcaccaacttttcctagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggtaagtgcttgggaatcccatgggagccagagctgaccctaactacttttcaccttgagatccttctgagtttggagatatatttaagtggaaatatgttccagtttactaccactaatattggaacagtgggcaagatcacaataatcagtcacaataatcactagaatgtaagctccatgagggccgggattttttacctgttttgttgacctctatatcccaagtgctatgtgcctggcactgtactaattgctgatatactatttcttatcctcacaatcccactgtaaagaatgtattattcttaatattttctttttttttttttttgagacggagtctcactctgtcacccaggctggagtgcagtgacgtgatctcggctcactgcagcctccgcctcctaggttcaagtgatttccctgcctcagcctcctgagtagctgggactacagacacttgccaccatgcccggctaatttttgtatttttagtagagacagggttttgccatgttagccaggctggtctcaaactctcgacctcaggtgatccacctgccttggcctcccaaagtgctgggattacaggcgtgagccaccacacctggccaagaatgtattattcctgtttttttttttgtttgtttgttttttttaatttggaaatggaggctgctgtagataagtgacttgccaaagattcacagctaataactggcagagctgggatctaaatcttaccatgtctcacaggcaccaaagcctgcgttctttccactgaggcagaactatcactttaccttcctataagaagctatgaatctgtgaacccttgttttctcattctccctttccagtttgggagaaatagggacaaaggggcacaacttctgccaaactctggatttttgaaattattgcaaattcaaggtgtggctgacttcagcaaatttaattaactattgcatgttgagacttatgttgagagactggggctaatccagaggggagttttaggggacacaattctatgaagatagtaagatataatggacaaaataaggatttgagtatcagaaaggcttggatctaaatcctagctcttttactttgtagctttaaggaatttcacaatatagcaaaatgtaaaaccttaaaaaatggttaagaataatttatttgacaaatatttattgagtactgaccatgtacctggccccattctacatgccgaagacatagaaatgaataagacttatgaagtccctgtcctcttgaggtttagataagagggcttggcagactatggcctgtggacccgattgggcccactgcactgcctctttttatatagcctgtaagctaagaattcttttttacattttttaatgtttggaattaaaaaggaaataatattttttgacatgaaaatgttgtgaaattcaaactttgtccataaacataaatacaccccttcatttacatgttgtctatggctgctttcatgccacaacagcagaattgagtagtagcaacaaagacttcatggcctgcacagcctaaaatattaactgtctgacactttacagaaaaagtttgctggcctttaccttagattctagagtactgataagaaaacatgaggcccagaatgggaatcgggaggttgggagaaggtaggatagcaaggaaatggcaggaatggagttagtatacaaaatatttgccatgaatacttaaacacttggtggagcagtgtcacaggtttggttccaaactttctagagaaaacaaaaagagagaaaccaatggttatataactaagttcctaaggtaaaagcaagccaattgttcaggtaagccataacttttctggttttgaggccagggaaaaatttcttccatggattatttcatataacaacctcagtatgaaccaatggcattgtctcagagcacaatttagtaaaagctattcagtgtgcggatgggagggggtccagtacaatttctacaagtccagtacaatttccacaagtagttgactctgaatgctctggtttgatccactgatgctgatgtgatcactcatgcgatcacagttaatttatgtaagctgtttgtaccttggtttccagatctgtaaaatgggaaaacagttcacctgttagaattattattgctaggattaaaaggaatgacaaaatatctggcgtataatcagcattcaaaatatgatattgatttccctcccctgtccctcttctcactatgacttggctcttctgagacatagccaagaaaaggaaaactttaatgtagacctctgcttctgtttttaagtcatgtcgtgaccttcctatcaatctgggtagaaggttgggtaactcaacttatactcgtcacagtaaaatttgtcttgtctgttgccaagccttgagactggccagattctatcagctcagcgcacacagtaactcagccctccttccctccctcctgcaaagttcaatcccagtggcattcccctcttccccttcctccagtcctaccctgggctgctggcggcagctactctgatctaatggtctcagctaatgtaagtactgatctgacttgttcagtatcagcctaactatctaaatctgggcctcagctttgcctggcttcattttctgctttcaatcagttagcaacaggctggcacgatgcagctttttttcaaaaccccatgcttccagctttggctacagaaagcagaactgaggtggttttggccttggtggagaaccccccaaacctctggtatagttgcctctttgaacctaacctacactatctattcacttcttacttcctccttgctcccctcctgattctggctgcttctcctagtagattccctggcatctgaagagttatcggttaagcaaaagccacacacagctctgaccctgtgctataactggtagttgtttgctcctggtactggccagtagcctgaatggcagtattagagggagggaactgttacctcagccagcccagtctgtaccttgcagttgtcaccccatttcagctctgttgtttaggactttgcctgccatcctgaggatcagtacacaggctccattgcattagtgagccagctgtgccacagtcctgcccccatcttcaccccttgcattgacttaacatttgagtggccttaacattcttcacattttttctcagcaattaaaaataacaaaagcatggtgcatgttaaattgcttttttccatgacagtcaactttaaaataagaatcagtagtgtttgctgatggaattttatcaaggatccttttctgttccagacatgagcttgatactttcactcttctgttgcgtctaatcattgtgataggccttgtgaggtatgatttaccctcccctttttatagatggagaaacagaggctcacagacacaaaacaacttgctcagagttacctaggttgtaaggtgcagagatggggcttgacctcagcttcttgggttcaagattgggactctttttctttataccatatttcttcagcagcgttggccatcttctcctttctgtttttctaaggaccacttacttttgggggggtacaaaattatacaagcctatttttttctgccttcatttgagtttactgcctcttaggtgtcctggctttgcaaagggcaggcatgtagctaccgcaaagggatttaggactttcctttgggtaatgaagagggaggagggctatatcccatctactttacatgtatttgtttatttaatcaggtataatcatatgcaaagggagagacaaaaatgaaaagccattgtctctgccttccaaaggtttgtggtgacactggcatgcaagcagtcagtcccagccaatgtgattaatgttctagtaggggtgagaagaaattctagtaggagcatggagcaaggagaccttcattctacctgaggtattgagatgaaagtgaagagcacaccatggactgggactttatgacatatgggttgaggggcccttcttagctcctttcctctgtcttggctggaaaggaaagattgcatctggtggcatgcttttgggcttgtaaggccttgctcagtcacagagccattaattctccactgaggtgactaatgttatgagtggcatttgcatctactctaaaagtattaggaacagacttgctcttgcagtaatgggtgttgctggccattatccacattttcttgtttggacttatgctttaataatctactgtttggtttttattctctacttttcttggagcctaacgccaaattgttttataaggataaataatggctaaggaagcaggaaggctttaaggtgagcatggaggagtgtcatagaaaaaaagaggtaattctaggtgactgggggaatctacaagaggaatcaacctcctcctactctgtgccttcaggttgggtatagaggaatataaggaaaggtggaaaaaagttgctaaggttgaatactgatgaccatcaggtcccaagaactctgcaaatgttaagattctttggttatggtcatttgacagagattagagagagagggaacaggtggggcttgagaaggagatcaagtttgtagtaaaagccaggtttcggaccaaagttgaaaagaaattaaaaagaagtacagcttggtggaaagcctataggctcaagtgacttagtggttaaaagctcaggctcctgaatcttccagatgtgagtttgaatcctggctctgcctcttcctagctgtgggactttgggcaggttacaacctctctgaaccttagttttctcatttgtataatgaggatagtatttgcgcccataggattgctataacaacaaagtgagtcctctacatgcctagcacatcaagagtactcagtaaatgatagcagttgttttgctttcataggagactattactagctacttgatcttagttagttcagctttacttctttgagccagttttctcaactgtaagtggggacaataccaccattgaaggcaaggattttgcatggattaaattagattaggtatacaaagaatctggtaaaataatagaggcttaagaagtggtagtattactaggtaacaacctcttaggaaatggcagacatggaagatggggtgtctactcttctgtattcgaggccctttgagaagcctcaagcctaaaatgtagatggcataaaagagttcagagttatattttcaacccacaacctgtccctaccatgccaaacacctaggaagaggcgaactaacctcaaggtctaactcaagtctcattctgtccatgaagccttctgacaatcctaccccagttagctctcccttgattcacatattttggcacccaagattgaccctctaatgtggatgctagtttatagtattcacacttgtttcccatgaatatgacttatatcccccaactcagttttgagctcctagagggcaggggtcatttgtgtgtctttgtgtgtgtgtgtgtgtgtgtgtgtgtgttagagtgtagggttgggcacaaaagccctcacaaaacccccatattgaataccgttcaatttaggtttcagagagagaaaaagagagagacagagggattaattattttaaagcaggttaagtacatgtagagtacttcaaaaacagcctataaaagtcagctgggtctaacatttaagtcagtccagcaggccagcatggcacatgtaacgagcctatgtaacgagcctgcacattgtgcacacgtaccctagaacttgaagtatatttttaaaaaataaaaagtcagctgggagagatagaggcttatagacttagatcattggctcattcatctggaaaaacagtccaatccccatgttatactggtaaggaaatgatccgctgaaggtcacacagaaagttagttttagtattaatcatagaatccaggtttcttgactaccagttacattactctcccctttctgcctcaccagtttgatactgtggcttaactgtgactgagacacattagaggcaagagagaacaacatcggtgtcttcagccaagaaaatcctttgctgctacctcaaagctttacttgtaatgaataatcatttggaggtagcaataaagggcccaagaggaaatgaggttaatgatgtttgttttccaaggccctaggttcatgttcattaggatgtggctataacttgggaatgaatagggttcatattttagggatgtcatctggttcactcatcaaggcatggtttcaggtagacatgttttccagctctaacagtccagcatatcatttctttacaattactgccttcccctccacaactccgcctcccagcagtaaccagtggaaatggggcagcactctcagctctgctactctgtggggtgcagtgaggaagcaacatcatatggcttaatggtcctcaatcttggctgcacatagcatcacttgggaagcttttaaaaatacccatgctcaggatccatcctaatcaataaaactaggacgtatgagggtggggtccaggtactttacaattttaaagctccttacatatttctaatgtttcactagggttgaagaacagtggtagttgggactacataggtttcagaaatcagatggactgatcaactatgaagttacttttcatctctgagtctctgtttcctcagctgtagaacggagataatactttctgtcttgcaagattgtggccagtgttgaatgagaaaatgtgcataaagcactgagtacagtatcacagtacctggaacagaacaactgttcaataaaggttagctaaaaaaattttgccagtactattgtattaccattactattattattataatttataatttttatattaccaatgataacaaaacagcagacaactggaaaggcagtgggtgtggaaacaggaggtatgggtttcagccctcactctaccatttaacctatggttgtggatgaatcagtttacttttctgaacctcagtttccttctctgtaaaatggggataataagacctatttattcatctctctcaagcttattgtaaacattaagcagttatcgtctgggagagtgctttgaatagtataaagtatattagaagaattggattattattatcattttggttaattttttctgctgcaatgctgtatacccagtctgatgttaaggggaatgacatgtccagaacgtaagatgcagactaaatggagagacaattcatatgtgtgcacatgaatagtgttttgtttcttccttaattagaacaccaatcacactgtattatcattatttctttacatatatatcttgctcaccagaatggctagatggatgaattttttaaaaaacgtacatattaatatataagaacttcacgaacatttacatggatgtgaattacatatacctactagggtgttcagagggttgagattttagctgggtcttgaggaatgattataatacacaggagacataagaatagggacacatatagggcaagaagcaggacagagtctgacgcttacttacctctgctgtatactaggcattgtctataggtcatctaattgagtccttaaaatcaccttgtgaggagggtttttctttctttttttttaaattatattttaagttctgaagtacatgtgtacaacgtgcaggtttgttacatatgtatatatgtgccatattggtgtgctgcacccattaactcatcatttacattaggtatgtctgctaatgctatccctccccgctcctcccaccccatgacaggtcctggtgtgtgatgttccccttcctgtgtccaagtgttctcattgtacaattcccacctatgagtgagaacgtgcggtgtttggttttctgtccttgagatagtttgctcagaatgatggtttccagcttcatccatgtccctacagaggacaagaactcatccttttttatggctgcatagtattccatggtgcatatgtgccacattttcttaatccagtctatcattgatggacatttgggttggttccaagtctttgctgttgtgaatagtgccacagtaaacatatgtgtgcatgtatctttatagtagcatgatttataatcctttgggtatatacccagtaatgggatggctgggtcaaatagtatttctagttctagatccttgaggaatcgccacactgtcttccacaatggttgaactagtttacactcccaccaacagtgtaaaagtgttcctatttctccacgtcctctctagcacctgttgtttcctgactttttaatgatcaccattctaactggtgtgagatggtatttcattgtggttttgatttgcatttctctgatgaccagtgatgatgaacattttttaatgtgtctgttggctgcatgaagaggaggggtttttatactcatttcgcagatgaggaaatttacagtcgtagaggtgaagtacctgtctagggtcctacaacctggaagcagcagaacaagatctgaaagccaggtctacaaaactccagactctgtctcacttagaagtaagagtcaagggtttgccttaatggggcagtaggcagaccaatttgattagagtagaactgatagttaaaatccagggttactgcttgggacagtaatatgggaccagctcaaggagggccttgattttctgtgaaggagtttaaacttttatcttctacattttagagctgttgggaaagtctttaaagagcagaaaaacagtgtaaaaatacttaaattaaattttatagttgtatatgtagattcaatttagtatgtttttacatttactgtaaatatttttgtagaaaaaaatggatgaatataaagatccactgacacccttgcatagttatgtacatgtctatttcagtatggtcttcatcaggccatgagcactttctgtggacttttttttcacttgatattattttgtatgcctgtttttgttttgacctggtctaaatttttggcagttcacacataatatgtattggttaaatgcttgtatgaattgaattgtttgtttagcctttatggttaagtctgattttttttctgataagatgcatgtttttgtgccaattgctttttcttaagtgttttttttgttttgttttgtttttttgtttttttgcctcttggattagtccatttgggcctgttcccaaaagcaaaattactggatcaacgagtatgaaccgtctcatatgtatgattttgtacttcatccacattgttccagaatccttgatgccctctagataaaataagcccagttcacattgccaccagcaatgtgtgagtttacctgtttcactatagtcctactagaaccatcttatttaaaaagtgtttatatttattttgtactaactgacaaggaaactaaagacacagaggcaggaaagtgagttagaaaacaactataatagtcaaggcctaagtgaaaaggacctggatatcagtgatgatgaatttaagcaattcaaattcatcatcatcagacatttagtaagcacctactatgtacctggccctgcactaaacatattagtacctgatttaatcctcccactatctctgtaagataatatattgtggatctttattatatagctggggaaactgagacttagggaatggatatgacacacccaagatatctgaaactccagagctggggttcaaatatagactttctgaagggacagttgccagaaaaattacaaaaaaaaaaaaaaatagccagagttgttagtcaccaagaagaaatggaggccaaggaagttggcccaggtaactctcatattgggtgcctgctcatgagtagtgttctgtttggctaaccatccaagttcctggtatcattttctcttccaggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtgtaagtagggttgtacctcaaagttgactgaagtcctgtactaggccactaggaatgctttcaggatcaccatattaagggtatacagtgcacagccctggggcatccttcactttatagtctagggaaatatcataggccagccctgttgggagtattccactcaatgctcaaagctgagggatttctctaaagctgaaacctttgattcttagtacctgctaggagacccatttttcttagcttcctttatctctgtatggtgatattattaccttctgattttagcttccttggctcaggatattttttaaaaaaatttcttgttatttctactggttttaaaagtaatttaatgaacagattcattcactgtacttatgcttgaggcttttattttaagcaaagggtatgatttaaattttttttcaaaatgactttggttctccagagagtctcttacagggtgggagctgagctgatgtgcaacagaccttcctgaggctgggccgcaagccaaggaaccaaggaaggagcagctagggtgggaccacagcagtgctcagggaccagctttgcttggccacaacgcgcttgcctgtcctctctttatcgactgggaccattctcagtatactgcctcctggtcttcctttttcttgtctttcttgttttccataattgtaaaattggagaaaaagaagaacaaagcctccacagctttgactaattagcttactatatttacaaaaagccaacaattatactttgaaatcaagactggtttcatttatttcccccaagaagagcctgactcagcaacatactcagaccattctgaagcaatggggataaagagtgtcagctatggccttaggggtgcctatgggctctgggccatttcacatttgtatgtgtagggcctttgccagcaaaggcaggggctggcattggtgtcccatctggttcagagtctcctgtcctttctgttggccattggttctcacgtgtataccaaagcaacttatgggacttggttggcttctgtttgcagggtggcttccaggaccaggttttttgaaacagcttcccggaaaacaggaaggtaagatatggaggtgacaaaagaaaaaccaaatcgccttttaataactgcatccttagcatacaattgtgctcactctaacatctttctctttttgtttctctacagctctgtctctgtctgtcactttctcttccccaattctgtctctccatccctatctgtctgtcacctgttcacctgtgtgtctatttgtttctctcatattctttttctcacttggtgtctctgtccttttttttttttttttgagatggtgtctcactctgttgcccaggctggagtgcagtggcacgatcttggctcactgcaacctccaactcccaggttcaagtgatcctcccacctcagcctccctagtagctgggactacaggtgcacgccatcatgcccagctaatttttgtattttcagtagagacagggttttgccatgttggccaggctggtctcgaactcctgacctcaggtgatccatccacctcagcctcccaaagtgctgggattacaggcgtgagccactgcacccagccagtgtctctgtcattctcaatctctttctgtctgtctgtgtttctttgcctgtgtccccatagttgtctttatctgtctgtttctctgttcatgtcactctatatgtctctgtttttctcttcctgtgtctctttgtatctgttgtctctttgcctcttcatttcttcatctctctctctgctcatctttcccttttctctctcacaagcacatatgtctgtgcacacttgtgtgtgcatgtgcatgtgaacacacaccaagcagtatctcaaagactttacacccaatattttttgttagtttttttttttagtttacttttttgttattttacttatttagattccattatatactcaaagggcagctgacagggatatgtagaatattacactctaagataaacagccttagggcccccatttcaaaggtaaacattggacttaggcagtggttctcaaactggctgcacatctaagtcacctggaaacatggagaaaaaagtcacatattcctggatttcattctagacccactaaaacagaatctctagtagtggggcctgggaatatgatttttttgttttattttgttttttccttccctccctttcttcttttccattagtttgttattaaaacttctcaagtgctggtacagactgtccaaggcctggaatttaggaccctttggactagaacatctggagagatatttggttagccttcagggactcttttgtgagtttgttccttcttggttatcagagagtttgaaattgttcctcctaacaggtgacaggagcagaactcttctaggtggtcagttaaaagcagaacaatatacctttcccagcagtggagttggggtagattttccatcctctagtcaaaactatgggaactgacacactaggacatgattctgcacagcagttcattctagctctgattgtcagtgagccacctggaacctcaggctgggccaaattctccttagacaataatttaccattcattctaccatagcagatgaaagtcagatcaaggccccagatttctcttactgatagcatgaagataaaagttttcacctcagaagttttttaagtaagcttaatcaaatatctctcttgagaaaagaaaaagaaaagaagaagggagacgaagagagtctcaaatattcttaataaggtggcctatgccttcctagaataagccacttgagaaataaataacaaggaaatagaacgatgtaaactggaatgaactggatatgtctacaggaaagctttttagaggaggtgatatatgagttggggcttgaaaaaagaatagaactagacagaaaaaatgctgtgggggcagttattgatctgcaagcttggacaggaaaccaaggcattgagaaggaaatatgtaagaagcatgaagaaagtccaatagaacttttaaggcaggtagacttacaagagggaagctatagccaaactggtgttgagagtgtgaaaagattggtagccactaccaatgggctgggctttgtcagccagtgctcgaggaagccttagatcaagcacaacctacaagggctatggccaaagcaggcacttcaggctagaatatcactctacccaccctatgtctgggcttccagaacctagatttaatcctgttctttattcctagattccattttggcaggaatgtaggtaagaccaaagtaggtacacttgctctccagtatgtcatgaactaccatcctgagtacccacaggctcctcccactcagcatccacatagggaaagcatcccttccatctaggcctccaccttgtaaccaccacttgcatcagtgcttccacaggttggcctctgatcaagatcctcagaccagtcacatagtcagtcccgtctatggtcattgttgctaagttcttctctcatctctaatgaaaatgatgatctttttaaactttgtcttgcccctttttggtccccatttgtatacctgactacggcctagcgtttgaatgacatcacccccttattcatttcccttacacaatttaaacataaataactaagaagaaaatgagtagtggctcatcaagaacataaaggaggtgagaacatttcaaagaggcccgacagcttatggtttcagaagttattagtgttccactttggctagaatgtgggagtgaaaagagggaaacttagctgggggtgagaccagaaagatggattggagccagatcgtgaaggcattgtataacatactaaggtgcttggtctttatactgcagtccatatgcggatgagtcatagaaaggggggaagaatttcaagaatgacagtcacattctgagctgaccaagttgtaaaaagatcactttggtagtgggaaagatagatgggagagtaaagactggagaccagttaaggagactaattgtcctggcaagagttggggaagccctggcctatggcattcccagtgggaatggaacagaagggacagatttgagaaagactcaataagaccttgctacattttcaaacatggaacattgatgaaccgagaaagagaaaagtctaacttgggcacttaagtagatggtacaataattaatcatggagaagcaggttttatgggaaagatgctgagctcaattttggacacagtgattttgaagacacagttgttaaatttatacaaattttttaaagacactttgagacttaggtagagatagatgttcagtgggtaactgcaacttaggctagcagttggagctggatgtatgtatacatagatttgggggttagaaatatgagtatagccactatataagtctggggagtggggctagtcacatatgctacaatgtgaatagtagcctgttgtggggaggtccctagtatttggtggcaattgaagccatggatgggaataagatcctccagggagtaagtgtaaacagactggagagaagagaaaaacagaaggttgaggacatagccctggggaccagctgttgtacgtaatgctctggccacactagagtgggtttcatttgccaagattttctcctccccaagctgtccccagacatgggtaatttagaactaatccaagcacatcaagaggctggacaaggttggtttggtcttctaggcaaaggaggattcatctttcacatggtacttgtctgtgtcctcacccttatccctgttagagatcatcacagaatgtagttcgtggtctgcagccagcttccctgggttctccaagcttcacatagtctggtactcagagaattgttctggcacctgaaagatgtcttcacatctctttaagcctgccagagaaggagccccaactataagcatggagctaaatgttttgaaacatctgggctgaatcacttctccatttttcaaatggcctctttagcactggcctagaagtgtcccccattcccccaatttacctttccagtcctgatttctagaatcttagtgaaacgtctttctttatccacagttctcaaggcagacttcctggagatgaaagttgaggctacaggtatgcagtccccatccctgattacaaaatcttgttccacataagccttcattacgggatctgatattttgaggactggaataacatgtagatcagaagggtgggaactcacttctacgcctcagttcattactctatcactgcctgacccttaaatttagtgactttcaattccaaggttttgtgtgattttaagtaaccttcctctttcatttctttttctcctagccaaactatggcacgcttttacagattgcctttgaatcaaatttattaagaatcctaggctgtgacattttgggaaagtacatttacttctctgagcctcagtttcccagtttctaaaatgagaaggttggaaccttctaactctgacacctctcgggcctttaaggaaaccaggaacatgctttctgatattataacagatgccaagaggctaccttagtgtctgtagatggattcattcctgcagaccaaatcattatttcagtcttacccacctgaaccttcattcttagtcctttatgtttgtccaatgcaaagcactttcacattcattatttcatttgatgcatatcacatgccaggagaagggaggataatatgtgttctaactcaacaaataaaggaactgaagttcagaggggataagtgacttgcaaaggtcacaggagactcagaggtcagggaaattcctttctctatcataggagttctgattgtttgactatcagattgctggcatgatgtgacctgataacacacataaatgagatccaagtatctggagcttggcttttcatgtgctccctaaccttctttttttccctgtcactgccagtcctcagaggtccgtgggtagataagcttctccttatcagcccctatggaggtgaagtccctgttaaaaggaagtttatagttattgtatgaccataaaggcagtgggcatgatgtgggaagaaatctcagaggttctagtatcaggcttctatttctccatgtagattttggggagtttgagttgaggtcaaaggcacaaagtgtccagccctggtcatagcaccatcttaggcctgtttcatgagatttgacttgtaagagcctttgcccagcaatccgctgttgctcagaagatgagctaccaattataggcttagctacctaccaagagaagccccactgatcagtggctgttaagtacttgaccagtcctcgctaattccctactctcttctttctctttcaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtc

SEQ ID NO: 3432 - DNA, 391461 bp, human
tgtgcgtcgcgctctcgccctcctcttcccgctgcagtgtctatggagcgaggctacgtttcattgccgccctggcttaacccttccggcgcctaaaaggacggccggccggccggctcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacaggtacctgtcctccaaagggacggaggctatgagcttccttaagcgggtcgcgcgctcagtccgtcccctctacttcctctactgtgccattgatgctctcggtctttgtgtctttcccctttccccctactcccggccatcagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaagtaagtgcaaggcttcgatgagctgtttctctgagctggtgtgtctggcctttaagcctttccacaccaccaggggaagggagattgcagggtgactcccagcccagatctctgaggcaaatgggtttcccacacttggggagtggagatagtagaagtggaaagtggtggatacaaccagaactttgggccttttcctttagtggttttgaccttataagacgtgatccgtagctgtgccagggaccctcttgctcagcaattacccttacttggcagatgattgttcttaagggacaatctgctgtactgttagacatattcagcacccctgtctggggcaaagtgacatccaagctgaccaaggaactgccccagcacctcctaaacaattggggattaaggtcagcagcttgaataataattttgtcctggtctctggttgctacagataagtgtggggggcagtaaaaaattcgccatggcaagttattttttaaggaaagcacctttgccccagtgaattattttctttatcacactgagctatggtttaggtcaaggtcagtctaagttcaggattattggatggcttcacctgccactgaattctgcttgagtgtggaacaaagagctgactacttagtccctgccacaaggggcccagcccccagggagtaaaatagggatagggttgggggctgctgggctgaaggaacttcacctagcttcgcttttccagtgctcacagctgactcagctgtgggaagctctctccttcccccattgtgtgtggaggttttttttctgcttgttggtaggaggcttggagtaaaagaaagaataataaacatccccaacgagagtgcaggcaagccaaccctttatgccaaagcatatacacagaagaatggagggtaatgattgggtggagtgataattaattttttctcttggctgaaagatgattgtgaaaaataaactcagagtcattggcaagtatgtcctatatggttataactttgttttgagtgaatttatcaccaaatacagggtctaggaccagtgtggcaaccttcttaggcggatgcagtcaaccaagagcagggagaaagaaagatttgaaagtggtagtgcgaggctgggcgaggtggctcacgcctgtaatcccagcactttgggaggccaaggcgggtgaatcacctgagatcaggagttcgagaccagcctggctaacatggtgaaaccctgtctctactaaaaatacaaaaaaaaaaaaaaaattagctgggcatggtggcaggcacctgtaattccagctactcaggaggctgaggcaggagaatcacttgaacccaggagatgttggttgcagtgagccgagaccgtgccattgcactacagcctgggcaacaagagtgaaactccatctcaaaaaaagaaaagaaagtggtagtgtgttggtaactgctgccagctggtatttcttgtgcagcccttctgatttgccctgtggagtcggtgcttttccttcacatgctctctgcccacttttggtcagaatatgtacactgtcgaagttcctgcaggtcatttgattgtgtttgatcttttaatgatttgtcttattgtggcctgaccaagagtaaactcctagtagtatctgaaatgctgatccttaagaggttaaggatatgcaggttgtgctacataagtagaaaggtgagagttcacggaaaggaaaaggaggaatgtttcagctttgttttgttttgtttatatattacagtaaactgcttggtgctgtgtccccagtaaaacgaatctcatcataagccctaggaacagaatggctttgtgaagtggatggtaactaaaagcatgctaaaaatcaccagctaaggcatatcagagagattaagatttataagaaaaaaagtagttcaataaaacatggtggaagagcaaaagtttcataagctaggggcaagtaaaggtttttattctttccttttctttctttttttttcaatttttgtttttgagatgaagtcttgctttgtcgcccaggctggagtgcagtggcatgatctcagctcactgcagcctggatctcctggtttcaagcgatcctcctgcctcatcctccccagtacctaggactataggcatgtgccactgcgcctggctaatttttgtattttttggtagagatggggtttcaccacgttagccaggctggtcttgaactcctgacctcaggtaatccacccaccttggcctctcaaagtgctgggattgcagggatgagccaccacgcctggcctctttccttcttttctaagactcaaagtgataagagtcaacagttaagcagatctaaaattttgcatatgagcagaagatccaagagatattctagattaggggctccttgaaatttgtggtagttttctgtttctgagtatacacagaaagccaaaaataggacaggtagaaaataaaacccagcagctaacccattctccatttctttccattcaattgcatggattctaaaagtctgattagctagaggcaaaggtaggatgtttcctactgtcttgaccacagtgatgtttatactcccactctccttcctcacactgtgccagcggagcgactttctgaaagtaggtagggtggaagcaaaacaaagttatgttcttgctctgtgttgaggaaaaaggaaaaaggaacactggaatcggagttagaagatcaggattatgttcttggcttctccatcttgggatctaacacaaatcactttttttttttttgtttttttctgagacagagtcttgctttgtcacccaggctagagtgcagtggcatgatcgcagttcactgcagccatcgccccttgggttcaagtgatcctcgtgtcttagcctcccgagtagctgggactacaggcacacaccaccagatctggctagtttttgtgtttttagtagagatgggtttcaccatattggccaggctggtatcgaactcatggcctcaggtgatccatccactttggcctcccaaagtgctgggattacaggcatgagccactgcacttggtcccacaaatcacttttcatttttcttgttttagagacagggtcttgctttgttgcccaggctggagtacagtggcacaatcatagctcactgtcacctctaattcctgggctcaagtgatcctcccacctcagtctccccagtagctggactccaagtacacgccactatgcctggctaatttttaattttttttagaaactgggtctcactgatctcgcccaggctgatctggaattcctgggctcaagcaagcctcccaccacggcctctcaaagtgttgggattataggcgtgagtcaccacacccagccaaatcacttttttttggagacagagtcatgctctgttgcccgagctggagtggagtggcatgatctcagctcactgcaacctccgcctcccgggtttaagcaattctcgtgcctcagcctcctgagtagctgggattacaggcacctaccaccacgcccagttaaattttgtattttttttagtagagacggggttttgtcttgttgcccaggctggtcttgaactcctgagctcaggcagtccgcccccccttggcctcccaaagtgcaagaattacaggcatgagccaccgtgcctggccccaaatcacttttacttcgtctgtaaaatcggggtaattatacccacctcccaagattgttgtgaggctcaaagaaattaatggattatgaaaatgatctgtaaatggaaatggctaaacaaagttgttgataatacatcttcggattcttaatatatctgttggtgaatgtgtcattttctgtaggtttctgaagggaaatgcataagcagaagtagttggaactcctcttgcttaaatgtgatctcttcataattgttgaagtgcaaggtgattataacttaaactaatggaaaataaaaataccatccctctgaaaggtgactatattgccaacttttctgtttgtcctttatttttatattggtagcttcagtccccaatgttgtttgaatatttgctaagccctgaggctaggcattattcagaacaagtgatgtggcccctgctcatatcacaaagcagcatgacacatctaataagtgttatatatagttagcgaatgcatactattcattcaatacatacttggacacataccgtgttcaagtcattgttcttggagctgtcaggcatacagaatgagtcacagatggatactgctttcaagaggttcttaggctggtgggagagacaagacgtggatagaaatgattgtcatataaggtagtagatacagatgagagccataaaagtgggaacaggtggacctgatgatatatgacatgagagggaaagctgatttcccagtgggagcacaagggagaagccaaggaagaagcaccatcagagttgggtagaattaataacactatcacttgtttagctgttcccatgtgtcaggcattacatcttgtaacagatttttgagataaggattattattcccattttttagatgaggaaactgaagttcagatgagttaagtaactttctcaactagtaagggcaagtgtctgaattagaacctagacctgactctaaaggccctgcttatcctactgcatgacactattcaggacagggcatttcatgtagcgggagtgacacagaatataaaggggacagcaaataatttgagtcatctggggtataggcaacagaaagggaggtttgggctcctgaggagctggattacagccaccatgcccagctaatttttgtatttttagtagagacaggatttcaccatgttggccaggctggtctcgaactcctggcctcaagtgatccaccagcctcagcctcccaaagtgctgggattacaggcgtgagccaccacgcccagcctacattcttttttttttttttaattgtgctagctaaataaaacattttcataggccagattcaatcaggttgcaacccctgagctaaatgatacagctctacaagtctggctcttggactctaatgggctaggaaaatagaggatgacagtcttcagataggggctttcctggggaagcaacaatggatactctttgcaaatgagcagaggcgaaatgatggtataatgggacaaaaccctggacatggcatctagatacctgagtaaggtgctggttctgttatgggatctgtgaccttgataagcgatttcactgggaccccagggtctgtggctttacaaagatggggctggggtgggaggtttataaacccactttgagctctaacattctatgacttactatgttttgcatggcatattatagtttcatgatttgagaaaggaatgactaacccaattacaggaccttattttacgcttacataaaatttcacattattttagtgtaaatgacagtatttaatttaacaaaaaattaaaacagaattttttgttgttgttgttgttttttttttttgagacagagttcactgtgttgcccaggctggagtgcagtggcgcaatctcggctcactgcaacctccgcctccggggttcaagtgattctcatgcctcaacctctcaagtagctgggactacaggcgcatgccaccatgcccatgctaagttttgtaattttttttttttttttttttagtagagatggggtttcaccatgctgtccaggctggtctcgaactctcgacctcaagtgatctgcctgcctcagcctcccaaagtgctgtgattacaggtgtgagccgctgtgcctggcctaaaagagaatttctaaatacccttttccaaaccaaggataatgtgctttataagtatgtttttgtttttttttttttgtttgttttaagagacagagtctcactctgtcacccagagtggcatacttttaagtacagtggcaccatcatagctcactgcaacttcgaactcctgggctcaaaggatcttccggactcagcctcctgagtagttgggactacaagcacacactaccaatcttagctaactaattttttttttttttttttggagagatgcggtcctgccatgttgctcaggttggtcttgaactcctgggctcaaatgttttttccacctcagtctcccaaagtgttggcattataggtgtgagccatcacgcccagcctctgtgtatgtatatatatatatatataaaacagatgtcagaaaaaaaatatatcactaaacccacatatatacgtgcacaaccacacatacataggctctcttggactaatgaaaactcatgttttttttgttgttgttgagacagagtcttactcagtcacccaggctggagtacagtggtgccatctcggctcaccgcaacctccacctcctgggttcaagcgattctggtgcctcagcctcccaagtagctggaattacaggcgtgcgctaccacgcccagctaatatttgtatttttagtagagacggggtttcaccatgctgaccaggctggtctcgaactcctgacctcaagtgatccacccatctcggcctcccaaagtgctgggattacaggcgtgagacactgtgcccagctgaaaacttatgttttaaaagaatccagggtcgggcttggtgactcacgcctgtaatcccagcacttttggaagccaaggcgggtgggtcgtttcagtctaggagtttgagaccagcttgtgtaacatggcgaaaccttgtctctacaaaaaatatgaaaagttagctgggcatggtggtgcgtgcctgtagtcccagttactcagggggctgaggtgggaggattgcttgagccctggaggcagagaggttacagtgagcagagatcactccactgcactccagcctgggctacagagtgagaccctgtctccctctctaaaaaaaaaaaaaaaaaaaaaaaaaaagaatccagtccaggtgcattggctcaagcctgtctcaaaaaaaaaaaatccaaaagatgcattcagtactctaaatgtacataaaattgataaagtagaaataattctatagttttaataactcaatcttaattttttaaaaaaaggtcactgtcttacattctttgcttttaaagttagagttttagatgtttacattaaggtcaccttttggggtacctttgcagctttcactttggcaaccggagcacctatctggtgagtggttgctttcctggaaggatgggttgattccaattctgccactagctagctatatgactttaaacatgtctttagttttgtcggtctcagttttcccattttataaaattagaggcttggtcaataatatttacggttctttctggttttattattttgttttctggctaccaccatgctagtcaaatggtcaaacaatgtgaattgattctatcataaactttaggagccaattcatcttcactctgggagaataggcaaagggaaaatccaagtagtatgtccagcatgagtagatgacttgctgacctacttgactatcctctcattgaatgcttcttggtaggtctccacctgattcccttcagttctgttctgaatagctctatactgagggaccccaaagcttttaatccctttgggatgggtgtagtgccatggtgtgcgggaggagttggtgatataatatgcattcttgctcagcaggtatcttgtcattttcccagtgatatttaatcagtgcctctgagcacatggagttattttacatcttctccagagtaactcagatcaatataatgggtatgtcatttggtactgctgttagtattaatagatgtgaagcaatgctaaatggaatttgacagaggtgatatattgccatattcattggagttcctcacaagaccagattccagagtagctggactgtggctgctgtgggaactaggattgaaaagtgaaccaagccaacctttcagtgtgtccatttataagaaactattcttatttgggagtagaggatggtgccaggctggggtagggaagattttagcttgacttgcctgttaagaaaagttttccaatcagactctagagtgatgaaggaactttacctttcagcctcatttttatagccttattttttttaagcatagccaaaaccttttgtttaatctggcatctgtttctctaatcagttactacagaaatttcctaaaagcctatgaggatctggaaagttacacacttttccatgggagtaccctggaaatcttgagctgattttattttctagtggagtggaaggccctcatgatcctttaccaggcttgtatcaagtgctaaaccttgggcaatgtaaaggcaattcagtttaattcaagaaggttttactaagcacctactatgtgtcaggtactgtcctggaaactggggatacagtggtgaataagaatactatagactctgcccttttggaacatatgttaaatatcaaattaccctcttaaataattaattacaattgtgagaagagtatgaagaggaaattcagtgtgtgattttttttttatttttatttttatttatttatttattttgagatggagtctagctctgttgcccaggctggagtgcagtggcacgatcttgactcactgcaacctccgcctcctgggttcaaacggttctcctgcctcagcctcctgagtagctcggattataggtgtccgccaccacgcccggctaatttttgtattttcagtagaaacggggtttcaccatgttggccagactggtgtcgaactcctgacctcaggtgatcagcccacctcggcctctgaaagtgctggaattacaggcgtgagccaccatgactggcccatagtagaattatttataatggccaaaaagtggaaacaacctctaaatgtccatcaactgaaaaatggataaataaaaggtagtatagacatacaatggaatagtatttggcaataaaaagtaatgaagtactgacacatggtacaataaggatgaactttgaaaaccttaggataagtgagaaaagtgttataaatgactacctattgttcatgattcctttcatatgaaatgtccagataagcagatctattagagagagtatcaggttagtgattgctaagctggggggttggaatgtattgggactgctaatgggtaaagggtttctctttggggtcatgaacattttttaagattggattgcagtgatggttgtacagctctgtgagccattttatggtgtgtgagtcgtatctcagagctgtttgaaaaaaaaaaaaacattgtgtttggagaaacaggtgacaggcgcttgtcttatatacctatatcttcctttagctctatcttatagaacatcagacctggaaggttgtttagaaagctacacatctatggctgggcgcggtggctcatgcctgtaatcccagcactttgggaggccgaggcgggcagatcacgaggtcaggagatagagaccatcctggctaacacggcaaaaccctgtctctactaaaaatacaaaatattagctgggcgtggtggtgggcgcctgtagtcccagctactcaggaggctgaggcaggagaatggagtgaacccaggaggcggagcttgcagtgagccgagatcgagccattacactccaacctgggcaacacagcgagactccgtctcaaaaaaagaaaaaaaaaaaaaaaaagaaagctacatatctactccactgggtttatatgtagggaaaagaaagtcaagacagagagttacttctccagagacctagagctagagtcggaattgtgaccagaatcagatttcctggtttccctttccaaggccttttcttttcttttcttttttcttttcttttctcttttcctttcctctttctctttctttctttctttttccctccctccctccctccctccctctctctctttctttcttccctttccctttcttctttcatccttccttccttccttccttccttcctttctttctttctctctctctctttccttctttctctttcttccctttccctttcttcttctttcctccctccctccttccttccttcctttttctttctttctctctctctttttcttttctttttctttctttcttccctcccttctttctttcctccctccctccctccttcccttccttccttctttctttctttttctttctctttctttttctttctctccctctctctctctttctgtctgtctttcctcattgcaaccttgaatcccaaccccaagcgatactcccacctcagcctcccaagtagctgggaccacaggcacgtgccaccatgcctggctaatttttaaattttttgtagcgatgggattttgttgtcttgttgcccagggtgctctcaaactcctgggctcaagcgatcctccacctcagcctcccaaagtgctgggtccaaggctctttctgcaagcaggtagcttgcatttcaactgtcttgatgttctttatcggggctaggggtgcttttgtttgaaatgacccagatggcagcaaaaattgcattagtggaaggtttcttttcagtatttcctccccattagggctaggatcaagtgatttccctgttgagcaatctagctcagtttaattagggtctggttgtgttctgtttcctttgtcatagaataatggcaatacatcttggtggtgtgatacctgtcctctttgttttctgccccaagagcctacaccagctggttgagcagttcccaaagtctcccctctttgctcatctgtcgacctcttagggcaaacacagctgcttttcatgtagtgagtagtatatattgggaaacgtgtggcattactaacgagtgacaaagtccttccccatattatttttatcctaaggcagcttggaatttttcacaagtggtgagcagtaagtccagcactatagtgccatatgaggaactccaaggcagttctttacaaaaggttttcattaaggacttcccagaagcaggagggccacacttcaacttccaactctttccagagccaggctgtcatggaaaagcttttctctgtgattggaaaaatatatattatgtatgtggcaattgacagctggagactaatcttgaattcatccatcctgaattcattaggtgggaggaagagggtgggtaataaggcattgaggtgttttatagctgccccttacaacttttgttgagtacagaaaaaaaacaaaaaacaaacctggagcattgtaaagaaaatgcctctgccaccatcatcactatgctgaatttcttttgctctaaaacatgggaaatattgatttttttccctgtttggttgatgtggagaggtttgtcttctagaatccatgcccagtatttgagggattatggggatgattgttctgtaatggcattaaatgggaaagctaggggtaccagtgtgctaattgggtaacaactcagccagggattggataacaatgaaagcagagtagaaggggagggaaagctggggcttcttggaattttgtttgcttttgctttgtgaagagcagatgctatttgtatttaacaatttccttttctttgactaatcggcagtatcttgctggaattggactcagagttcgaggggccttttcaacatttcatttaatgccttcatatttcagatgaggaaaccgaagcctatgaggggtgttccttgtccaaggtcacagagccagttagtcacaaaatcagtactgaaaccaataatcggtcctactgtgcttcatgaaaacagtttctacccttcaggaactctctttgctgagactgtgatttttttttttttttttttctgttgagaatcactttcagcttgtgaaagaaagaaaagagttgttttttcttcaatgcatcttgccaagaatgcacgttcagtgtcagcctgaaggcagccaagcattttacagacctgcaggaatgaagtaggggaaggttcagggagtctgaagttacttctggagtttttctggttagcctttgcctagtaggagcttgataaaaatagaagatcaagagacagaccttctataatagatctttcccccaaatatgtgaaatctagagaatccatttatgaatgaggaagaagcaactctaatacaaattgagttgggttttaggatgtggatatataggtagatgtaggtataaactgccatttgcaaagctctttacagtataccaggcactttaacatacattctataactaaacagggaagaaatgtgttaaattacctccaatttatagatgaggaaactaagatttagagaacctaggtacttccctaagattgcatagctagtcagtagttgagccaagacttagattttctgtgtattctttccacggttccccattgtttttattccctttagtgatgaaagagaatataagtgctgtacagaagaatacatagttcagaaagtagaagtgtcaagaagacatctggggccttctgtagagaaacggaagtagccgtctgtacacatacccataggaagtggtggccattagaaaatgtttgaaagctggagaacagcattagagaagtgggtagctgacagggctgagacacctgagcttgtggtaagaatttctatgtgctattctgtgaaggctgctgaggaagacagtccagaccaaggtagatgtctttaaaggagaattgcctgaagccagtgaggtggttaaaaaaaattggggaagatgcatattggtgataaaggagggagtaaccttgggcatttttcattacgtctttagggtggaaaaaaactagaaaattataaagtagtggtggggcgtggtggctcacgtccataataccaggactttgggaggcccagatggggcagattgctggagctcagtagttcgagaccagcctggccaacatggtgaaatcctgcctgtacaaaaaatacaaaatttagccaagtatggtggcgctcacttgtaatctcaactactcaggaggctgaggtgggaggatggcttgagcccaggaggcagaggttgcagtgagccgtgatcacaccactgcactccagcctggttgacagagccagaccttgtctcaaaaaaaaaaaaaaaaaaaattgttaaggagttaagaaagaggaaaagtaggatggtattttatagactacttgcttttttattctagaagtttcatagatggtgcagacatcatttagcccaagttacctgtgaatgttgagtttggggatgattgttctgtaatggtactaaatggggaagtgcggggtgccagtgtgctaattgagtaacaacttagccaggaattggatggccacgctagcagagtagcagaggagagaaaggccataatcccagcactttgggaggccgaggcgggcagatcacttgaggtcaggagttcaagaccagcctggccaacatggtgaaacccctgtctctactaaaaatacaaaaaaaaaattagctgggcatggtggcaggcacctgtaatcccagctacttcgaaggctgaggcaggagaatcgcttgaacccgggaggcggaggttgcagtgagccgagatcgcaccactgcactctagcctgggtgacagagaaaaactccatctcaaaaaaacaaacaaacaacaacaacaaaaaatttaaaaaaaaagaagtggagggaaagctggggcttctatcttgcttggaaccagtttcatccttaaatggagttgtgtgtttgtagtgataccacacataatacttcgtaaaaataatcacagtataatttccttcttagtatttttcagttcaacaagtttcacctatgatctcgatttgatctttacaacaaccctttgaactaatcaggcagggcattattagtgctctcagacaggtgaagtcaccaagggcagataatggtcccttgttttacagatgaggaaatttaaattcagagaagttatttgctcaaaattgttccactagtgtgtggcaagttgggattcaaacccagatcttctggctcctagaggtggaaaattttttactatattatgatgtattatagaaggaggtcaatggttatgccttgtagggtgcgtttgggaagtctgcgtctctgggccttcctgtatggtgtcttgccattgtagttacctgattctccctgatgtctgtcccagctggcctggctttgcactcagccctctcctgctccttgagcctctcctcctaataccatctttgcacacagctcagtctctgtaaaaccctgtcatgtatcctcctcggggttgcctgtgtctgccagtatctccttttccctctaggacctgaggaagccctcttagagaccttgccttattgtgcattgttttgaaaattgccctcctagccagccatccctgctctaatgattcaccttcaaactgtgatttcaagtcttttggatcttcttatgccatgtgttaggcagcctctgacattcagaggggctcataaatataggtatgctatggtagtatatttaggaccagttcttttgcctccttcttacccatatgcctttaatcagcttctgctcctctggcaatatgggcataattggcatgtgttttcagcagagctcattatagagatttccattgcagcaggcaattttgtacaagcccctgtctgacattattaccaaagctattgccgttgttttgtcaggtctaacaagtccagcaaggtctggctgattgaagcattcattgaattggccactgggcaaggaggcggttgcttggcagttcttctcttcagggagggtttccttttttagtagcagtcttacctctaaggagtcagcagctccctttagaactggctttcccaaagtgtgtttccccacccttccacccagtggcttccagttgttctgaaagctgctggtcaactgtgcctttaatatttctaatggcaggagttaataatgtgatgtttaatagaaaacatgtgtcatcctattggcacaccagagaaggcagctctggtctctccattaaaccagcaaagatttttgttttttaatggtgataagtagaaataagtatatgggatacccacaggtatcttttactttgaagtcttttgtagcttctgcttttgagaataactgatagagggaaacttcttagccttgcacctttgctttttgctcctttccagaagtcctgggcagaagagagaggggataaggaatagtcacttgaggttgggcgtggtggctcacgcctataatctcagcactttgggaggccaaatgggtggatcacctgaggtcaggagttccagacaagcctgggctacatggcaaaactccgtatctactaaaaatacaaaaattagctgggtgtggtggcatgcacctgtaatcccagctatttgggaggctgaggcagagttgcttgaaccccagaggtggaagttgcagtgagccgagatcgcgccactgcattgcagccttcatgacagagtaagtctccatctcaaaataaataaataaataaataaataaataaataaatataaaaaggaatagtaactcgatttctcaaggagatctatttgtagtaaagcaggagccagcatgctgtggctcatggccaaatcctgtccacctcctcttttcgtaaataatgtctgttttcataaataacgttttattggcacatagccacacctatttgtttatatattgtctgtgactgcttttgcaataaagtggcagaattgagtcattgcaatagatacagaatagccctccaagactaaaacaggctgtgcaacattaattggctgttgttgggtggggcagggcattgagttccttaagtgttccttggaccttcttgtttgtgtccagcttctgctgagtttgtgtagagaggtatgcagggaagtggttttggaaatgacctattcccgcatacataatgaaagcttggaatgcaggttgtgctatgaggtgttttcctgtttgaatgggcaaagtgttcatcatcagagatgtattcctattgcctaccccggggcctgacacagtctcagttctgatctcaagaaactctcatacaggggttttgcttttcccagtgggcattcagaaacacactggttcactagcgcagaaacagttcatcctttttgactgtctgtctttgtgtatttggtcacgaactcctttttcctctttcccattatagatagtcgatgggatttttcacaaagcccttgaatagtttgtatgtgtttgttgattttgaactttgaactggtatatatataataccagcactttgggaggcccaggtggggcagattgcttgagttcagtagttcgagaccagctaggccaacatggtgaaatcctgcctgtacaaaaaaatgcaaaaattagccaagcatggtgatggtcgcctgtaatcccactactcaggaggctgaggtgggaggatggcttgagcccagaaggcagaagtttcagtgagcgctctctctctctctctctctctctctctctctctctctctctctatatatatatatatatatatatatatatatatattatataattttttttttttgagacggagtcttgctctgtcacccaggctggagtgcagtggcacgatctcagctcattgcaacctccacctcctgggttcgagcaatactcctgcctcagcctcccgagtcgctgggactacaggtattcaccattacacctggctaatttttgtatttttagtagagatggggtttcaccatgttggccaggctgatttcaaactcctggccccaggtgatctgcctgcggtggcctcccaaagtgttgggattacaggcatgggccaccacacccagccttgaactggtatattaagccctaaagtgtattatacaattgggtaatatataagcagtctgaagctccgttggcagagaaacccatggtttttgatatgttatttgtcataagctaacagggacctttttctctctttgacacagttgggaagttctttattaaaggggccagacagcagttccctttatagttaataatgatgtaatacaccaagtagtgaaggctacaggacaggagccacagaagtcaccacagggcacattgcccagtcaagctttctccagctggtcagataatatttcactgaggtctaaagagaagaaatgttatgaacaggagcaactctctgcttccctgactcttaattccttctgattgattggtatgatcttgttatttcaggatgattattttagtatgatttaatacagatttaaaaaatatggcagttataagtttctatctcatgttattcatggtaccttttcaaaatggagcaatctggcctccaaaatctagctatagagaataatcacaggttcccatgtgtaagtagggcaaagagaatcagaattacaatattagaaagagtcttgagaggtcatggagtcaactcctctgcttcctagccacctaaatcagccaagacagacgtggctagagaaagaatggaattagattgttgccttgtagatgtcttccatctttaactctgtccttttgagagcagtagaaactagtttggaaggggaaatgctaacttttggactgcagggctttaattaagtcttcttctttttttattcttatgcacctaaagaacatttgggactaaagtggttaaagacatagtcttggttgaagttaggttactgagcttaggtttcagcatattctctgtctaggaaattgagctcatcagcaagtaatggtaatgggaaggcttagcacaatggcatttagttgccagaatgaccattggcttgggaggcacacagatctgggtttgaattccctatttactatctgggtggcatttgaacaagctatgaacttcttaaagtttcagtttcctcaattataaatggagacagtaataccaaccttggttatagaaggtatacatgaaataacatatttgaaagtaatatactcttaataaatgttagtctctactgtttaagtatatattttaaaaaaacatacttatgacagtgcttgtgccataaacaaacttaaattgtagtaattaataacttaattggtgtttggatatggcttatgacttgaaaattcaagaatatacttcacaaagagaagagaaaaggaatatgagtgcatatttctcatagtcacacagccttacccatattccaatgacagtaaagtggggactgatcagaaagccttctgggatagcatataacagcagccacactcaccaataaggtattggtatgcctgatcctctcctccttttcagtaataaccatttgagaaagattagcattgttatttatagtgctcttgggtctgatgttatatcattgtggttctactggcactgagaaagggaacaatctttagttctggtcaacgtgcctaacataactcctggccctcagtagtctctaagtattttatttgaatgaattaataagaccctattttacaggagataaattgagacagaacggttaagtggctcatctaaggattaagagagacagagttcttgtcaataatgggacctggtctactgccttggttcttaacacatattcttccctttccaggctgtcttatcccatgaatattgtgtaatacactgtaaagagacttccttcccccttatgagctggtgatttgcttgtacctaaattaagagagtaggttaaagatgcaatgagagtgctttatggcaattcaaagtataatgttttctctaggatttctttcattttgtttgtttgtttgttgtttttttgtagagatgggggtctcattatattgctcaggctagtcttgaactcctgggctcaagtgatcctcctgccttggcttcccaaagtgctgggattacaggtatgagccactgaacctgccctatctaggatttcttagtttttggaattgcaacagagagggataaccccttttttgcatgttttgtcagagctgaggttgaacaaagggccctgggtgggcgtgtggggaaggataggtggttacggcatggattttataggcagatggtgttggcttggaagaaaatcacagtaacagtaacatgtgggtgtgggtgtagagggatatcttcttttccagcactgtatctttgaatctgcccaccttcccctgagaattggctttgattaccttgatgttggttattctgatagacgaagctgcagggcagggctaatgtacattaatggagatgtgtgtataaatcatctcacagaatatacagacatcctctgtctctagaaagttggcctctttttgaacttctcactatgtcctagttgttacagaagtaatttagaaaccccagaagaaatatataaatagggtctattgcatactgggcctgaacaagctggagaggaataatttcacatttgatggcaggctattttacttgtttgtctttcttctccctttgcttcctgccttgctttgagtgactgcagaagctttttgtgattgtagggagccttggccaatgtgggaataggacccaggaattcaaatttctcacctgacatctgcagtaccttcagaatgcttctgaaactgatataaatgaagaaatactccaaaagattactattgaacaacaaaataaaaactttcacatgataaaccatatttagtcgcattcttcccttttcaggccccaagtatatagctgagatgggtctagtgtctttctttttatgtaccattttaggcaagttcttctcagtttataaatagacttttcattctcaacccttcttatgtgggcaagaaaaaggatttgtttaatagagtctgataaataatttttaattgttttaaattgtgataaaatatacataacataaaggtaccatcttaatcatttttaagtctttggttcagtgggattaagtacattcatattgttgtataaccatcaccaccacccatctccagaactcttatcgtcttgtaaaattaaaactatacacgttaaactttaactccccattcccagctgccctcagcccctggcatccattgttctactttctgtctttatgaatttgactactctataaatggaagtacctcatgtaaaggaaagtatacagtttttggctggcctgctgtgactggtttatttcacttagcataatgttcttaaggttcatctgaaggaaacaaaaatatttcacctgaaaatatacgtctttgtcatattttaagatgactgttcagagcaccagtaaacagaagtagccctgcaaagctgtctttttggggacatttgcagctgtagggaaaatctgcactgatatagccaggtttttttctgaggccctcccttgtccagatctaggaaagattaactgagagtctgacacctataaaggtctgaataaacattcaccatctattctctctgagggctctgcctgtgaagttttatctatataacaagaccacttctgctagccaggcctcctcttctccccctgttctgccaccataacctgattttccaccataacctgtttttggccatgcctcgagggagtttccattctttctgtaacctcaagatggtataaaagcgtcaaccctatacaaactctggaagaaaatctcggaaaataccattatggacataggaacaggcatagatttcatgacaaagacaccaaaagcaattgcaataaaacaaaaaaattgacaaatgggacctaattaggctaaagagcttctgtgcagcaaataaaactatcaacacagtaaacagaccagctacagaatgggagaatatatttgcaaactacacatccaacaaaggtctaatatccagaatctatatggaagttaaacaaattaacaagcaggaaacagacagcctcattaataagtgtataaaggacacgactgacacttttcaaaagaagacatatacggggccaacaagcctatgaaaaaatgctcagcatcgctgattattagagaaatgtaaaccaaaaccacagtgagataccatttcaccccagtcagaatggctattattaaaaagtcaaaaaataacagatgctggcaaggttgtggagaaaagggatcacttatacagtggttcagccacttcggaaagcagtttggagatttctcaaagaacttagaacagaactaccaccattcgacccaacaatcccattattgggaaattattgggtgagggttgaaaaactacctattgtactatgcttattacgtgggtgacaaaataatctgtacaccaaacccccgtgacatgcaatttaactatataataaacctgcacttgtatgcctgaacctaaaataaaagttaaaaaaataaaagcaccagctaccttgcctttctttgaattcttatattttgtatgattcctgtgcacattaataaattgtatgccttttctcctattaatttgccttttgtcagttgatttttcagagaaccagcaaggatggagggagttttcccttagccctgatacatccatcttgtaacatgtgtcagaatttcatttctttttacggctgaaataatattacattatgtgcatatacattttgtttatccattcacctattgatggacacttaggttgcttccactttttggctattgtgaacaatgccgctgtgaatatgagtgtacaaatacctctttgagaccttggctttcaactcttttgggtatataccctgctatggtgcgaatgtgtatccccaaatgcatgtattggaaacttaatccccaatgcaacagtattaggaagtgtagacttttgggagatgtttagtaatgaggcccctgagatgtttagtaatgaggcccctgttattatcagtggattaatacccttataaaagggtttgatggaagaagtttgttcttccactttttttttttttggtggagtctcagtctgtcatccagggtggagtgcagtggcgctatcttggctcactgcaacctccgtctcctgggttcaagcgattctcctgccgtagtctcctgagtagctgggattacaggcgtgaaccactgcactggccttttttgttgttgtttttttgctcttcggccttctgccatgtgagaacacggcattcctcccctatggaggcagtgccatcttggaagcagagcctggaccatcaccagacacctaatttaccggcaccttggtcttatatttcccagcctccagaactgtgagaaataaatttctgttctttataaattactcagtctgtggtaatttgttatagcatcagaaatggactgagatatatccagtagtgtaattgctgtatcatatagtaattctatttttaattttttgaataacttgataaataattttaaagttttcttcaggatccataatatttgcatgaactgactcataaaaatgttggatttgctactttgattcaaacccatgattcattcggccaggggttttgttttggacagtggcattaggagatagttgatgaaaagaatgatattgcttcacacagtgattagataccctggaagtccgaatttctctacatcttgacctcatattaatttttctaactccttcttaaacctgtttataactctaacccacataaaggagtttcctaagtctactcatgaaaatatgacgttatttgatttgtcctagaagtgattctttgaaacttcaagaggaatttccaagttctggttttttagacttgcttaaaaaagaaaagtgtattcacatatccttaccttgtgtgattttaaagatttgtattttcagccctcagccctcagccctcattcctcatctttgcatacaaaagaattgtattttttctgttagcaacctcacttaaaaacacatcccttgcttggtgagtttcttgtcctctttctggatcatctccagctgtcttatgacattctgaacattgtcctcagcattctagggcattgctgaagcctataaaagagattttggtctgcaaagtttataatcccctgcctagtgataatcaccttattgttgggcctgggttttttggagacagttcacaactcctcctctccaggactgtagccaataaaatgttctccagagatagggtactgacagatgctcctgtgtgttcatgagagtcagtgtggcccagcagaaagcactggcctagggtttatagaattaggattctagtcttaaatctttgctaaccacgcaatcttaggtacagttcaccttttggtgcctcaatttccctatatgtgaaatgggatcaagaacacctaccctgttcccctcacaagattattctgagaatcaagtgagatcatggaaatgaaagttctttctaattaagtgctgtatgcctagaggaaatgtcgattgagacttaaagactatagggtgtatcaagtaattttgcttttctggcttaatttttttatttataagcccatggattagttgctaattattattattatctttttttgagacggagtctcgctctgtttcccaggctggagtgcagtagcacgatcttggctcactgcagcctccgcttcccgagttcaagtgattctgctgcctcagcctcctgagtagctaggattacaggcacacaccaccacgcctggccaatttttgtatttttagtagagacaaggttcgccctgttggccaggctggtctcgaattccttgcctcaagtgatctgcccacctcggcctcccgaagtgctgggattagaggcatgagccactgtgtctggcccagttgctaagtagaataagtgatttaacatgcacatcagttagaatattgtcactgctgttacctcattatgttaatactactggacatttgaaggtcagatttctaataatctcaatatccagaataaagctgggagtctagaggcttgcctttccaaaaacggtctctaatagcttaagtggttttcgctgtgcactattccgtgggagagaatgttgtcctgattttattggctcttcatttaaattctgatgtggtttctaccccttagaaatttagaagcagaatctagggatttggaggtgaagtgaggagtctagcaccagaactttgatatgaaaaagaagtgacaatggaattgaattgaagtgtgtgtatgtattgggggagcctgaaaatattggggaaaacagatataaggcctataaagcattgtgctttgtgtctattttatgtagagttcaatagtcctacatacctgagcattctttgagtatgtgacagcctcagattgactgatgttgtcacaatgatgaagtggagtcatccaaaaaccatttaagaaagcagaaagctgggcatgatggcatatgcctgtagtcctagctgctcaggaggctgaggcaggagggttgcttacgtccaggagttcgagtccagcctgggtagcatagtgagaccttgtctctaaacaacaccaccaccaacaacaaaaagaatgcagaaaattaaatgttagcttagctttccattaaaatggttaaattacaaaagttctaaatgtttgaagggataaactttatttaaattgaaaattaactttttgtaatggattattatctgataatgctgaataaacagaacattattgtattaatattttgaccattatattacaaaggtatttttgttattttctccatttggataattttgtattgttatacctaatttatagtagaggacattgacaaggtatggttatgccaaatttatggcatcatttggagaggaatacatggttcttatttattctgatatgttaccatgctataaattgtataaggttttcctataggcattgtttcattttacctccataatgatccattgaggtacatatcgatgcccgcattttacagatgggaatactgaggcttaagataggatcaacatattcataaaagtggtagagcaatggatttaaatgttggccttttgactctaaagctgttgttttttctaagtcttccacttaggtatcatcattatgccttgtgttttggaacaattctgtaaaaaagaacatataggcatcattatccctattttaccatatgagcaaattgagctgaaagataccaagtgagctgcccaatggacacatgatggctagaacccaggtctgtcgatttctggaccattaactactttattttatgtatgtatgtatttatttatttatttattttgagacgaagttttgttcttgttgcccaagctggagtgcagtggcatgatctgggctcactgcaacctccgcctcccaggtgcaagtgattctcctgcctcagcctcctgagtagatgagattacaggtgcacaccactacgcccggctaatttttgtatttttagtagagaccgggtttcaccatgttggtcaggctggtcttgaactcctgacctcaggtgattcactcgccttgtcctcccaaagtgctgggattacaggcatgagccaccatgcctggccccagtatctattttagaaaccattttattttgaaataatttcaaagttacagggaagttacaaaaatagtacaaagaacctcagtttatccttcagtcagattcactgatttttaaaaaatattttgctctatttgtcttattctgtctctgattatttacatattattttttctggatcattttagattcagttgcatatattacgaccttttcccttaaatccttcagcatgtatttcccaagaataaggatatttattacatatgcatagtagaagtattaatgtcaggaatttaattttttttttggagatggagtcttactctgttgcacaggctggagcgcagtggtgtgatcttggctcactgcaacctccacctcccgggttcaagtgattctcctgcttcagcctcctgagtagctgggattacaggtgcccgccactatgcccagctaatttttgtatttttgatagaaatggggttccaccatgttggccaggctggtctcgaactcctgacctcaggcgatctgcccacctcggcctcccaaagtgctgggattacaggcgtgagccaccgtgcctggcctcaaagtcaggaaatttaacactgatataatactattatctaatctaaagtcaatactaaaatttaactaattgtcccaataatatcctttttgtcccaataatatctgttttattttctgacccagaaaacaggattatgagttgcatgtagttatcactggagtattgccttttttttttttgacagattcttgctctgtcacccgggctggagttcagtggcgtgatctcagcttactgcagcctctgcctcctgggttcacgcgattcttgtgcctcagcctcctgagtagcttactagattacaggcatgtgccaccacgcctggctatttttttgtattttagtagagatggggtttttaccatgttggccaggctggtcttgaactcctggcctcaagtgatccacctgccccagcctccctaagtgttgagattataggtgtgcgccactacgcccagcctcattgccctttatataatatcttgttgcttctcttagcccattatgtcccaaaagtttagaaaacatttcttggatgaaagaagtgcataaaatagaggttaaaaaatgggaatgtggaccctttccttttcagtcacctcaggttgcttgcatttttttgtgaaaactcatctaccacttagacctgataaagatcacttattctgcagcagcttctgcttccaacagagtggggatttgggcccctccaagcttttctgctgacatctaggaaatcccaggtgtacacaggtctgatctgagctgtaatgcaggagtgtggctgtgccaagctagggaagaaagaaaatcaccccaaagactataatgggccaggcatggtagctcatgtctgtaatcacaacacattaggaggccaaggcaggaggatcacttgagcccagaagtttgagaccagcctgggcagcatagtgagacctccgctctaaaaaatttttttaaaattagccaggtggtgtcatgtgctcgtatgggaggctgaggcaggaggctcacttgagcccaggtgtttgaagctatagtgagctataatcacaccacttcattccagcctgggcaacagagtgactcaaacaaacaaacaaacagactgtaatgagcagactaggggaatagatggaagagcaaatgctgtacctgatgtaggacattattatttcaaatgtgcatcacttttatgataatgtttgcatcacatacgaattctttttttaaaattgtggtgaaaaaacacataacattaaatttaccatctgaaccatttttaaatgtacagttcagtagtgttaagtagatttacattgttgtgcaacagatcactagcttgttttcatcttgcaacaatgaacctctatacccactaaatgctaattcccccttctccccccagccttggcaactacctttctacttcctttttctatgattttaacaacttttgttacttcatattggtggaatcatacagtatttgtcttttgtgactggcttattttgcttgacattctcagagttctttcacgtagcatgtgtcagaacttcttttctttctttttttggtttattcttttttaagtttctattctcctacccgaatgtgtcagaatttcattcctttttaaggctgcataattattcctttgtatgtatatataccgcattttgtttatccttttacccatcaatgaacatttgggttgtttccaactcttggctattgtgaataatcctgcagagtacataagtgtgcaaatacacctttgagatcctgctttgaattcctttgggtatgtacccagaagtgggattgctggattatatgataattctatttaaaagttttggccaggcgcagtggctcacacctgtaatcccagcactttgggaggccaaggcaggcagatcatgaggtcaagagatggagaccatcctggccaacatggtgaaaccctgtctttactaaaaatacaaaaattagctgggtgtggtggtgcatacctgtaatcccatctactcgggaggctgaggcaggagaatcgcttgaacctgggaggcggaggtcgcagtgaaccgagatcatgccactgcactccagactggcgacagagtgagactctgtctcaaaaaaaaaaaaaagtttttaggaaccaccatactgttttccataatggctgcaccattttggcatcccataccaattctctgaaataggtagagttgttatcattaagcctattgtgcagataaagaagctgaatgacttacatatatacaaagttacgcagcggtaatgtaaaactgagacttcaacccaggtctcctggctctgcattcagcatctcatttcctcttatcttactcttctgcttgtgccacccctccagcgctcctcagacatgactgtggcacttcacttttagcatttttctgagtctagatggtacaactgtttcctttgctcaagaaatgccctccccatcaagcagtacatctcgtgcagtacctgagttcagaatgctgcctctgtttagactcaccattgcccttttgccttgttctcttgagcctaggatcgtacacaaggcacatttgaggaagcagccaattggcacggctctgtgagtctctacagcagtaggtctatgatagggacgtttattttttaaagtcgaaaggcacaattgctctttgatttagttgctgaacactgaccccctgcttagatttctgcaaattgaaagcagctatcatttcaacatcaacaccttcaaaaagaaaacacgcttgcacatgctcaaaaaattgctgatctgtagggaagagtagcaattccaaaaaagaaggcatatgatttttatctttcagtagtaattaacactacccttctctctaggaaagcttcctgccaggagttgtgtctcctctctgagtttaaacttatttgctgcctttttccttcctagagatcatctcaatattctattccacttaaaggcatttgacaccggttctgtatctgggctctgaggctaatggtatgaaagcttccaagacaaactcccaaaactgtagattcctgaatcaagtgtcttgctggagtctgtagacttgaaacatttggcagctgtgctgcttttcctatttaacacacagggacatttggcggctaggactgtatcttaattctccatctttggctttgctttcttcatcatcttcccatctcacccatttctgatttgtgcagtgttggcttgttcaaattctgatcttttaggacactgtcattctttctaggcaggctatcaaaatgttcagtctttacttcagatactcctgtacacctcagattacacctctctgtgaaaacctctcccccaattttatcttttaacgtgtgagtatgtgcctatgtttgtttttctcggagagaaagatggtatctccctagagtttagttgactcccaaagtttaaaaactactggccatatgtggaacctgtcttggccctttccattatcacaatgcctcaagtcatttgcaaacctgacctgataagcactcttctgaagattttatcaggacctatttctttggtttctggttcttgatatggcactacctataactctaactgggctgtttgaagagaacagatcatgaggcccatcaacataagatatgcaataagatttctttatacttggggtttaatgattcagttcatactgacattaggcattatttactttgcctttgctttgagtcaaaatccggctaagcattttccccacatcctactgacttctttattttggttcatggtatttgtagcctaccagttggcaagaatggaaacctcaaagacaggctcttctcttttcttctcttccttctcttctcttctcttctttctctcttcttcttcttcttctccttctccttctcctccttcttcttctttttcttcttccttctctttctttctctcttttcttttcttttctttctcccttctttcttctccccttctttctttctttcctctctcatgacccttacatccaataaatgcctaagtctggtagatttacctccagcagtgtcttttgcattcgtctccacctttctcttgctccttcttactgctacatttcaaacacttttcactttttgcctgagaaaacactagccgccaacttctatccctttctccttcggttcattccatactgattccagatgaactgtttgaaactaaagcactcatcatgccacttcctgttcagaaaccttcagtggttttccacactgccggcttcctcaagaaaagagtgtgcagcctgaccttcaaggttttccagattatgggcctaagggtcttccagcatcatctcctcttacttccctttatatctttggctatcaagctaaattggactctgcactgttctgcaaacctgtgttcagctctggttctcctcggtctcttttgctcaggccattcttttttcctggaatgctcttacccccatacatctctgtttattgaagtctgcccatcatgcaaggcccatctcaaatcttaccttttccttgcattcttcctagatctccccaaccgaatatgatttcttcctcatttgaactctcttgggacaatctacatctcctgatgtttgtataatgcttggtattatgcactcatcttcactactacattggatgctcttggaagataaaagttgtctcttagtagtcttgtatcactgtacaattgtgttactgtacaattgcgttactgtacaattgtgttacggtacaatttgaaacttagggccttgtgtgtatcaggcttttagaaagtatttgtggaattgagtagagttttatttagctttctttgtaatcctggtagtctatctagaatctttctagagcgggccaaatgccaccacctttgaggatatcttctcagttagaattaaccctttgttccttgatgttcacttacatgttgtttacactgtacttgtagctgtctgtctcattactaagttagctgtattgtgaatatctcccttccttctttggagagggattggttctgatttattactgtatatctaatatggtttggatttgtgtcctcacccaaatcccatgttgaattgtaatccccaatgttgaaggtggtgcctggtgggaagtgaaaggatcatggtggcagtttcttgtggtttaacaccatcctccttggtgctgtcgtcatgatagtgagctcttgtgagagctgattttttaaaagtgtgtggcacttccccacctcttcttgcccctgctctggccatgtaggatgtgcctgaaagaaaaaataacaacaacaaaagacatgcctggccaggtgcagtggctcacacttgtaataccagcactttaggaggcagaggcgggtgaatcatctgaggttgggagttcgagaccagcctggccaacatggcgaaaccctgtctttactaaaaatagaaaaatcagccaggcatggtggtgcacgcctgtaatcccagccactcaggggactgaggcaggagaattgcttgagcccaggagtcggaggttgcagtgagccgagatcatgccacagcactccagcctgggcaacagagcgagactccatctcaaaaaaaaaagaaaaaagaaaaaagaaaaaaaagagagaagaaagacgtgcctgcttccccttcgcttttccccatgattgtaagtttcctgaggcctccttagaagcagaagccactatgcttcctgtacagcctgcagaactgtgagccaattaaacctgttttctttatacattactcagtctcaggcattttttttatagcagtgtgagaacagactaatacaatatctcatgctgattagcacagtacctggctcataatatcaccggtagagggttgtgactgcaagttgtccaggttcttggcgttttggacaaagaattggacaaaacgccctgcaaagcaaagaaagaatgaagcaacaaaagaacgaaacagggatttattgaaaacaaaaatatactccacagtgtggaagcagacccaagcagtggctcaagggcccagatacagaatcttcttggattcaaataccccctagaagtttcccattggccatttcatgctcacctcatgtaaatgaagtggtagcccagagtcagtctgattggttgcagaaagcagtcgaccagaggctgaagtgaagttacaaagctcacactcctctgcaaacatcctattggttacagaaagcaaccaatcagagcctgtaatcccagctactcagaaggctgaggcgggagaattgcttggacccgggaggcagaggttgcattgagccaagatagtgccattgtgctccagcctaggcaatgagagcgaaactctgtcttaaaaaaaaaaaaagaaagaaaaaaaaagaaactaaaacaagaccaatgtagttggaaggtatggagtagttgcccaatcactcagggcctataggtcatgctagggagatatagcgtgaacccctcagagggttttatttatttatttatttatttatttttatttatttattttgagacagagtcttgctttgtcgcccaggctggggtgcagtggcacgatctcggctcactgcaacctctacctcctgggttcaagcatttctcctgtctcagcctcctgagtagctgcgattacaggcatgtgccaccacgcccagctaatttttatttatttatttattttgtaattttagtagagacggggtttcgccatgttggccaggctggtcttgaactcctgacctcaagtgatccgcccacctcagcctcccaaagtgctgggattacaggcatgagctactgtccagcccctcagatggttttaaataggaagattcaagtgatgtgctttatattttgagcttactctggctgcacagtggagaatgaattcaagacaggcaagaatgggtgaagggagaccggttaggtggtagttgcagtggtataggtggaagaagttgatggcttggatgagggtggagatggagagaactgtattaatgggatatttaggagtttacataaatcggacttggtgataaattggatatggaaggttggggagatggagatatcaaagatggctcactggtttgtaaatagatggtggggccattctttgaaatggttaattctggagaggaccagttttgtggagaaggtttggcatattattactatacacacacacacacacacacacacacacacacacactttttttgttttgagacagagtcttgcactgtcacctaggctggagtgcagtggcacaatctcagctcactgcaaactctgcctcctgggttcaagtgattcccgtgcctcagcctcctgagtagcttggattacaggcgcccaccactacgcctggctaatttttgtagttttagtagagacagggtttcgtcatattggccaggctggtctcgaactcctgacctcaggtgatccgcccaccacggcctcccaaagtgctgggattacaggcgtgagtcactgggcctggccagattttgtatatatttaggaccctccctgattcccagtctaaggtagcacattgcctttaagttagggccttagctgtctgatattgtgtaaatgtgatcctaattcaagacaggcggaccagagcaagtgacttctttataaacctgatagccctgtgtttctgtgtggtttcttttccaccattaaatgcatcatcaccacagcagtggaatacatagaaggggttggagaacatttcgtgggtttaaaaatttcaagtgaaaaatatgttggattgaaatctttggaaactattccactgggctattatagttgcagctgaaaacaattaatggagcagcagatgaaaaaccaaaacatgcaagcattggggcactgtggaataaggggatcatttaggtgggcctttctaccattggatagggcataaattgagaaaagtgcacatgtagtcatgagcaagtattaaagtgtctccccaaaatactagcaaatagtgagctaataaatggaggtggagaaaaataaaaggcaagggacaatataagatcaaagacagcttctgtttctttgcagcattttgtgcccccactctggcaggttttctacagatgctctgatcaggaaccagctggccccagggctggctctcagtctctcctggcagtccccacaccccaagcaagatcattaaatcatccttttgttaagggacgatgggaggagcctaatctgagaaaaagaaaagtaaggaagaacagggttacacctgccagtgataaaaggaagactgtggcaataagggaaaaaagcccagggaattaagaaagggttaacctgtggccaggcacagtggctcatgcctataatcccagcactttgggaggccgaggtgggtggatcacttgcggtcaggggttcgagatcaacctggccaacgtggtgaaaccctgtccctactaaaaatacaaaaattagctgggcgtggtggtgggtgcctgtaatcccagctacttcggaggctgaggcaggagaatcacttgaacctgggaggtggaggttgcagtgagccgagattgtgccactgcactccaactggggcaacagagtgagactctgtttcaaaaaaaaaaaaaaaataaataaataaataaaagaaaaaagtgtcaacctaacataacagaccaaaaaaaaaaaaaaaaagaacataaaagacaaacagaaacaggctgtcaggattcaggatgtgataaggctgcagtatggaaatggattcagctacctgggaaacttgcagagttgcaattgaaaaagttaatgatgttctccgataagaagcctggggcactgagaaggcctgttttgtaactctgggaatcctttagccagccactgtggtccctggtttatagccaattagaagttagaaagaaaaatggaaaaaacaaccaaaggaaaaagttgttaacagctgctatgattttatctaaatagaacttccattacaggctgtgagaagattaaagaaatctgggtgaactgtgctggagggtggagggtgttccagcacagctcttgctgagcagtcctggtgttgctccaaggcaagagcagcttgcaatcaggaggcagttttcgctagccacccagagaagattaacctcaagacccaggtaattgcagtttctgtttgctcctcagtcctgagagagtcctatgcccctggggggaagctcccctgggatgggagaggagtaacgggtaaatttccagccacttactacttatcaagggctcatcctgtgacagcaggatactcattagtttttatttttatttttatttttttgagatggagtctcgctctgtcgcccaggctggagtgcagtggcgtgatctcggctcactggagcctccgcctccagtgctccagcgattctcctgcctcagcctcccgggtagctgggattacaggcacgtaccaccatgcccggctaatttttgtatttttaggagagatggggtttcaccatgttggccaggctggtctcaaactcctgacctcaggtgatccgcctgcctcggcctcccaaagtactgggattacaggcgtgagccacagcgcctggccaactcattcgtattcagagtcaaggactccctgattgtccctcatacaagttctcttgccctaaacacagggagagacatgtagattcacctagcctccacaaccttgttttttttttttttttttttttttttgagagcagtggcacaatcatagctcactgcagcctccaactcctgggctcaagcgaccctcccacatcagccttccaagtagctgggaccacaggcgtgtgccaccgtgccaggctattttttttttttttgtagagacagcctcactatgtttcccaggctcatctcaaactcctgggctcaagtggtccttccacctcagcctctcaaagtgctgggattacaggcatgagtcgccattcctcgtccacagccttgatccttactggctatacaaggaagtcctgctttgttctgtttcaggaaggaatgcttgagggtcccaccagccagcctccaccgccagtaatctattgctctgaatcccggatataccttcaaatagggagcttagattccttaggcatcctgaaatcaattgccttaatataaacaagtaacaatcagaatatataatggaaggaaagattccactttaataagaacagaaaagagaaaatacttaaacttaatggctgggcgtggtgactcatgcctataatcctagcactttgggtggccgaggtaagaggatcgcttgagcccaggagtttgtgaccatcctggacaacatagtaagacctcatttctacaaaaaaatgagaaaattagcagctgggcatggtggctcacgcctgtaatcccagcactttgggaggccgaggtgggtggatcacctgaagtcgggagttcgagaacagcctgaccaacatggagaaaccccatttctactaaaaatacaaaattagccaggtgtggtggtgcatgcctgtaatcccagctacttgggaggctgaggcaggagaatcgcttgaacctgggaggcagaggttgcagtgagccgagatcgtgccattgcactctagcctgggtgataagagtgaaactccatctccagaaaaaaaaaaaaagagagagagaaaattagctgggcatggtgttgtgtgcctgtagtctcagctagtcggatggtgggggcaggaggattgcttgagctcaggagttggagattgcagcaagttaagattgcaccactgtactccagcccgagtgacagaacaagaccctttctcaaacaaaacaaaacaaaaacaaaaaaacaaggccaagcacagtggctcatgcctgtaatcccagcactttgggaggccgaggtgggtggattgcttgaggtccggagtttgagacgagcctggccaacatggtgaaaccccatctctaccaaaaatacaaaaaattagcggggtgtggtggtgcatgcctgtaatcccagctactcaggaggctgaggcatgagaatcgcttgagtctgggaggcggaggttgcggtgggctgagatcacgccactgtactccagcctgggcaacagagcaagactctgtctcaataaataaataaattaataaatacataggccaggtgtggtggctcacgcctgtaatcccagcactttgggaggccgaggtgagtggatcacttgaggtcaggagttgagacaagcttgggcaagatggtgaaaccccgtctctactaaaaatacaaaaattagctgggcgtggtagcgcgtgcctgtagtcccagctacttgggagggtgaggcaggtaaatcacttgaacctggcaggcagaggttgcagtgagccgagaatgtgccactgcattctagcctgggcaacagaatgagactcagtctcaagaaaacaaaaaacaaaaaaaacttaacatgtaaattctacatgaagaaaaaatattacatagtaacataaaagacttagactcaggtattcttgaatagaaagataataacataaaaatattaacttgcctaagtaaatttattaaaataaactcagtgcaaataaagatacaattttttgttaactagataaactgattctaaaagttgtatgtaaaagcaggcaagcatgaaaacccagagaaattagtcaatggagagtaattaggggaaattaatcttatcagatattaaaatatagcatgctattaagctatagtagttaaagcagtgtggtactgatgcatgattctaaaaacaacagaacagaccagaaagtctagaaatagattgaactcagaaatttcatgtctgataaaggtggcatttcagagcagtggggaaatgacgtattatttaacaaagtcaggccgggcgcggtggctcacgcctgtaatcccagcactttgggaggccgaggcgggcggatcacgaggtcaggagatcgagaccatcctggcgaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaacaaagtctattggatcaccttgatagccatttcggaaaaaagagattagtatccatacctcatgcttgacacccaggtacatttcagatagatcaaagatttacatgtgaaaaatagggccataaaacttctggtaaaaaagggagtatgtaaaaattaattttagagtgcagaagccttacttatatgatacaaaattaggaagtaaacttgaaaaatagaaataaaaaagggacatttaaagtataattgaaaaaaacagaaaggaaaggatgatatgtttgacgcatgaaactccaatttgtatatggaaaaagtatcatgaataaatgcaaatgtcaaattggtagccctcatgcattgctgcagtagaaattgacagaatctctttcaagggagtttggcaatttcaatcaaaatttaaaatgttagctgggtgtggtggtgtgtgcctgtggtcccagctacttgagagcctgaggcaggaggattgcctgcacctgggagtttgagggtgcactgagctgtgatcgagcctctgcactccagcctgagtgaaagagtgatactttgtctaaaaacaaacaaacaaaatcactgtttttttgtttgttttgttttgttttttaaagaggcagtgttgcccagactggagtgcagttgaaacgggagagttccctgaccccacttgcaggacatgcaacagaggtgtggctcatctgttcagtcgctgccgctgctcaaaccccttacgggaagcggagcatgcaggtgaacaggtggaggagcccaagtgggcatgtgttacagtgtgcccttttagccctgccatccatggacagcttgagtgttaatcagctcagtggaccctctgcctttctgcaagggcagagggccagtgtgacagctttctgtatcccgagctcttgtccagtgtcccggaagaatcgagtcacacacgaacttgaaggatgaatgcagggttttattgcgtggtggaggtggctctcagtgggccggatggggagctggaaggggggatcgagtgggaagatgatcttcccctggagtttggctgtccagcagccaaactcttctctgaccactcccagctgaactcctcttggccttcagacattcctcctgttctctctttctctgctgcattgttctgctgttcatctgcttgtctcctcgtctgcttctggagcctggagatcagggtttatatgggtacaggatagggagtgttgtgggccaaaaggcaatgttttgggcgtgaaaacaggaatgactgtccccatttagggccgtgggtctccaggcttgagggtggggcctttgctggggaaccactctcttccatccagtatttgcctgtctcctgtgtgtatcacagtggtgcaatcatagctgactgctgccttgaattcctagactcaagccatcctcctaccatgcagtaaaaaatctccttataacttttgactccccccaaatttaactattaatagcttaccattgaccggaaggcttatctggtctgtagattaacacatattttgtatatgtattatatacggtattcttacaatatagtaagctagaggaaagaaaatgttaagaatcatgaggaagagaaaatatatttactattcattaagtggaagtggatcatcataaaggtgttcatcttcatgttgagttaggctgagaaaagagggattggtcttgctgtcttaggggtggcagaagaggaagaaaatcttcatataagtggatctgtgaagttcaaacctgtgttgttcaagggtcaattgtctattttgataatatgtataccttttgttgttttcctattgctaatgcaacaaattagcacaattttgtggcttaaagcatgcacatattatctgatagttctggaggtcagaagtacaaaatgagtttcactgctaaagtcaaggtgtaggcagggctggttcctcgtcgaggctctggggggagaacctgtttccttgccattttcagcttcaagtggctgtctgcgatccttggcttgtgggccatcctccatctttaaagcacattgctccaatctctgcttccatcattacattactgacttctctcctccattgatcctcctacgtccctcttaagtatctttgcaattacactgggctcatttgggtaatctaagataatcctaacatctcaagatctgtagctcaaccacacactagcagagtcccttttggcatgtaaagtaacacattcataggttctggggatgagggtgtggatatctttgagggatcattattcagcctaccacagatatgttcttgcataccctatctctggaagaaaaaaactgctgagggtagttgcctctggagataggaagctgggggctgacggacaagggtaagacaaaaacgtatgctttactgaatgcccctttgtattttttgagtttgtgtctctgtattctgtcacaaagtgaaatatgctcattgtggatattttagaaattgcaaaaaaagagaaaaacacaaaaatattaatcatagtgcaactgcccagactcagccactattaatattttttatatatttccttatgttatttctattcataattatgtctgtgatagaataatagcttccccaaaatatccaagtcctaatccttagaatctgtgaacacgttaccctaagtacccaaaggaaatttgcagatgtgattaaggatcatgagatgaacagattatcttggattatctggggtgggcccttataatagggaggaagaaaggtcagatagagagaagatgatgtggtggcaaaagtagctgtctaggatacaggaatatgtgtagcctctggtagctagaaaagtccaggactgaattctcccctagagctttcaggaagaatgcagccctaccaacacctttggacttctgacatccagaattgtaagataataaatttgtgtcattttaagctactaaatttgtggtaaattgtttcggtagcattaggcaattaatactatgtctttaataagcattccttcatgctaaaacatgttttgtgaatactgtaatagctctttaatgttattgctgtttattcttctagactgcaagttgtacaagggcagggaccatttacgtcttgatcaccattatatttccaatgtcttgtctgcagtgggcccttaataattattcatttagtaaatcagtgaatacaccacaatttatctaacttttctttttgagacagtttcactctgtcacctgggctggagtgcagtggcgcaatttctgctgactgcagcctcgacctcctgggctcaagtgatcctcccacctcagcctcctgagtaggtgggactacaggcacacaccaccacaccctgttagtttttgtattttttgtagtgatggggttttgccatgtttcttaggctggtctcaaacacctgagctcaagcaatctgcccaccttggcctcccatagcgttagaattacaggcataagccactgcacccggccccagtgttttcctttttaagtagctcctgccatatatagctgataataatattaataataatcgtttaagtgctttacgtactgatatagtttggctatgtctccacccaaatatcatcttgaattatagttcccataatccccatgtgtcactggagggacccagtgggaggtaactgaatcatgggggcagttactgccatgctgctattcttgtgatagtgagttctcatgagatctgatggttttataaggggcttttcccccttttgctctacacttctccttgctgctgccttgttaagaaggacgtgtttgcttccccttctgttgtaagtttcctgaggccttcccaaccctgtggaactgtgagtcaattaaacctctttcctttataaattacccagtctcaagtatgtccttataacagtgtgagaacagactaatagacatacattatctcaatttaatccttacaaaaacctcatgactggtaaatgctattattatccccctcgcccaaagtcacatagtgagtaagtggcagaaacccagatctctcagggtccagattcaacactcttaaccacaacactctacagcttgctaaatattggaacatcctgtacatgctgatttttatggctttttttttttttactaaatcacacatattaatatcttcccatgtcattacacattttatttatttatttatttatttatttatttatttatttatttatttttgagagggagtcttgctctgttgcccaggctggagtgcagtggcacaaacttggctcactgcaagctctgccttttgggttcaagcgattctcctgccttagcctcccgagtagctgagattacaggcaccctccaccatgtccagctaatttttatgttttagtagagatggggtttcaccatgttggtcaggctggtctctaactcctgatctcaaatgatctgcctgcctcggcctcacaaagtgttggaattacaggcatgagccaccgtgcctggcccatttttaactatcattaaaacatgttctggccaggtgtggtggctcatgcctgtaatccaagcactttgggaggctgaggtgagaggatcacttgagctcaggagttcgagactggcctggtcaatgaagcgagaccctgtctctaccaaaaaaaaaaaaaaattagccagagttgatggtgtgtgcttatagtcccagcaacttgggaggctgaggcaggaggattgcttgagctcgggaggtcaaggtggcagtgagccatgattacaccactgtactccaagttgggtaacaatgagaccctgtctcaaaaaaaaaaaaaatgttgactagtattccattgtctgtatctaccataatttctcagtacgatcttattactactaaataggtcttattactaaacattttagattatttccattataaacttaattcagtttgtttttatttttgatatggaaaattcaaatatatagtgaagtagagggaatagtataaagaactcatgtgtctccatacccagcttcaatctgttatatctatgcccctcacctagttccttccaccttgggcctggattactttgaagcaaattctcagacatcatatcatttcatctgtgaatactttagcattaaacactatttttatactataaaattgcctcagttgcctggattatcttcctaaaaaacacatctgatcagacactcaataaatagctgttgaatggcttaatccctttccctggttgcttgaaaatgcagctgactccctactgtctaaaagaattaataccaaacttctttttttttttttttgagacagagtctccctctatcacccagtcgggggtgcagtggggcgatctcggctcactgcaacctctgcctcctgggttcaagccattatcctgcctcagcctcccaagtagctggaattacaggtgcatgccaccacacatggctaatgtttgtattttgagtagagacagggtttcaccatgttggccaggctggtctcgaactcctgacctcaagtgatccacccaccttggcctcccaaagtgctgggattacaggtttgagccactgcatctggcccaaacttcttaaataggcatacgagaccctttatactctgaccacagcccacttcttcaagcttccttttctgttatttattcccatatatatcttccactccacccaccaaactgctttttgtttcctgactgtagtccacattcttctgacccctatctttgcttaagattccattctttgcctgtgctgttccctttgcatgccacgcccatcacacattttctccgtctggaaatactcattcttcaagctccagctcaaatctcttctgtaaagctctctgcatcacactcaaacatagtcagatgatccctcttcttacttgcagtgcctttgagttatacttttatttttgttttcagtatattgtattgtaattatttaatgtttctgctcctcctatgagttccttcagggcaggaacatgtcttatttgtcttcatcagaccatagcacctagcacagatatgtcaggtaagtgtgcactaagagtttgtaaaataataattaattccacaaatatttattgaatatctgtatgccacgcactgtcctaggtatgcagatatgttggtgaaagagacaaagtcccttttatggagcttaaattttcatagaaagagacataaaatacacgagtaaacaaacagatacagtattttcttacaggaataaatgcaataaagaaacaacaggatgatgaaagagtatcatatagtttgtattttcaagatacttctggctctgtgcattgaatggattataggaatgagagtggaagcagggcaatcagtttaggaggctattacattaatctgagtaagagaatggtggcttgaactaaagtggtggtggtggagatggtgagaaacgcgtagggatttaggatatacttagaaagtggaatcatcacgacttgcccatggaggggagcaagggagaggatatagggcagagagagagagagagagagaaacagaaagaaagagaaaaagagaagagaagggaagagaagagaaaagagttgagttttgtttggacataaatttgagatgcctatttgaaatgaataaaacaagagtagcttttggtggtctggcttcattcccctttgtttattgttctctgatatttgggaacaggggtgatagaaggaagaaaatcatttctctgtgacattcaagtcgctacagtttacctagggttttcttctatcccaccctttccaaatgttagatggcaacaaggtgttgttcctctcccctctccttccttctttggtttataaaataaaccgacccacacagctgacccttagcaagggctgtgtaggtctgcgaagtttaataacagttgcagatagattggctaagagaagtcagctggtgggtggcagggcaaataacggcttcatcagagccaaatacggatattagtttccccagtatatatgacaacttgctggtagcaaatgaatcttagaattaagacactgctaaacagtaaagatgattgttcagtattgggtttggctttattttgaaacattagaccctagagtttggatactggcccagtgaggccactggcaaacactattagtgcagattcaggatttttatatttctggaactctacgctatattcttggagactgctgccaaggtgcgcctggccacagaggtctgccttttatgccatagaaaataactgctttttaaaaaaataaatctttaaaagaaaaggtttattcattgtagtttcttgtctagtttcaggaaggggttaaatttggctttgattagtagtgggtttggatggagttatcataaattgtgtccagaaaaatcagaaaagctatttttttcccaaagccatcttctcaaaagattctattgaaatgttggcccgtcttctctcaggggctgaaagctttgatgttcttctttctctggcttgtggtattgtatcagtaagttaattgctggttcacaacagtttatggttaagtccttggaattagaatttttattccaactgatttacctttgggttgacgagtagcagaaagaaagggttcattgtttctaatctataaggcagaataaataatgcagattggtgggaagcatttcagagcaggcattaaaaatagtaaattatattaataagcaaagcctatccaactccaccctcttgactcttgggatgaaactgataaacaaccatccatgttcttttattggctccaaacacatgcaaccagcagagcgaacaacttgctgctctatgcacacttttccagtctttgtttttacttgcccctaactcagacttacttagatttcaaatgtgaacaacagagtctaacagaattcactgtttgtgattttttaagcaaatggttgttaagaaacatctggttatagttaataaagttcctcctgtgtgtgtgtgtatatgtgtgagatatgttttaagttgtaaggcttattgccacattcaggtcttattcttgtcatgctggtttccagaagataactagttaatcacactagtttcagaatatgaaatgtagaggaattttttcttttcctttttcatttcattctctgtttaccaaacaaaacatgactgactgtttcatcactcttcagacttaataggacagtcacagtttaacagtattctttgttatattggcctatggcaaggaattttagaagttgctgagatcttaattattttgtccagttatttctgggggagggtgggtaatatgcttttggcattggacaggatagttcttcattgtttgtctgggctgggcattgctagatgtttaaatacccgcagccattgtgccaagcaaaatcaactctgcatcttgtcagatgccccccaggagtagtactcctttgagattgaaactactgatctagtttaaacccttcctatttcagaggggaagaccgaggtccagagggacctgttcaaagctacacataactggactgcaacctagctcttctgagtcctagattagtgtcctttctcccaatatattttgaggggcttatttaaatacatttatactgattttttttaaaaaaattatttcaatagtttttggggtacaggtggtttttggttacatggataagttcttcagtggtgatttctgaaattttggtgcacccatcacccaagcagtgtacactgcacccagtatgtagtcttttatctgtcaccctcctcccaaccttcccccggagaccccaagcctgttatatcattcttatgcctttgcatcctcgtagcttagttcgcacttataagcgagaacatacaatatttgattttccagtgctgagttacttcacttagaataatggcctctaactctgtccaagttgctgcaaaagacaatattcttcttctttttttttttttgagatggagtctccctctgtcgcccaggctggagtgcagtggcacgatcttggctcactgcaacctctgcctcctgcattcaagcaattttccagcctcagccttccgagtagctgggactataggcaactgccaacatgcctggctaatttttgtagtttttcagtagagatggggtttcaccatactggtcaggctggtctcgaactcctgacctcaggtgatctacctgcctcagcctcccaaagtgctgggattacaggcgtgagccacggtgcccggccaaaagacaatatttcattcctttttatggctgagtagtattccatggttattctgatgttttttgtgcccttagagctttttgactagtgagagggccttcctaggcataagtatgatcaaaaggtggtggaatatggaatttacctagagcataatacaccctcattttaatttaatcaagaaaatttgttgaatgtctgctatgtgacagtctgggaaaatggtagtctcataaccctctacttttgaaataatataaatggaatggggtggtcatatgaaggaaattacttaacaatttagagggtgaccagtttttaaaagttgaaatgcaatgtaatgcttatttcataccggattatttattttctaggaatcaagtataatcaccagcttctttattttttcttcagtcacccctcccccatatacgtttctccccactttccgtttatttagcccaggtcagagtgaagagtgatcaggtaactggcaaacgttcctccttagggaaacaattccaaactcactccctggtcaagttgcttctagatcttggctttgtcaccagtaacactgaggcaaagatataaacagggaacagtcttctctgccatggaatttttgcctcagactaccaaaatgcaattcgttctctcatggatgagagaaagaattgaaagaacaagttggagctctctggggatccctagggggttgtcctcttctggagggccagttgttttccatttactttttcttgttttccatgttgagtttcgctttggaggatgttcctccaacattgcctgttttttttttttttttttttttttttctgggatggagactcgctgtcacccaagctggattgcaatggtatgacctcggctcactgcaacctccacctcctggattcaaggaattgaatccagcctcagcctcctgagtagttggggttacaggagtgcatcaccatgcctggcgaattttcttattgtatttttagtagaggcggggtttcaccatattggccaggctggtctcaaactcctgacctcaggtgatctgcccaccttggcctcctaaagtgctgagattgtaggcgtgagccaccacgcccagccaaacactgcctgtttaattcctttttgtcatgccaaaatgctctctgagatgacttagcagtctgcacttggtctgagatgagaggtgacctatttttctcctccttcatttctgatcctattcaatagcattttttttctttatttcttggtagagatggagtctgtctatgttgtccaggctggtcttgaactcttgcctcaagtgatcctcccatctcggcctcacaaagtgttgggattccaagcctgagccactgaacttggcctcagtagcattttcagtgttagctccatccttagtatgatgaccctcattcttcctcccaagtgggccacacgctacagagatcttgcctatcaccgaaaacaaaagtggacttcatgaattctatgggctttgaccaaatagtgttaataacttgcttttggggagagccccttttctgttctactctctgttgcaactcatctatagatacaagatctattctttttgtgggggtttaaaaaacaggtttactgggataaaattcacataccataaaattcacctatttatagtgtctcattcaatgttttgtggtatattcacagagttgtgcaaccatcaccacaatcaattttagagtattttcatcactccaaaaagaaaccttgtacccattatgaagacggcctactcttaaacttagttcattatcaataataataatatttggtgagggcttattctgtgcattaggctgagtacttgcctttgttatctcatttaatacttaaaaccatcctgtgaattagggactaatattattcccatttttacgatgaggaaactgaggcatgtagcagtttaaaacttgttcctatccaaactggttgtacatggtgaatcctagattctaacttaggccatctggtgccatagcattttattttattttattttattttattttttttaagacagagtctcactctgttgcccaggctgtagtgcagtggcccagtctcagctcactgcaacctctgcctcccagattcaagtgattttcctgcctcagcctcctgagtagctgggactacaggtgtgtaccaccacgcccggctgatttttgtattttagtagagacggagtttcaccatgttggccaggctggtcttgaactcctgacctcaaatgatccacctgccttggcctcccaaaatgcttggattacaggtgtgagccattgcacctggcctggtggcattgcttttaacaaatcataacactgtcacattttgtttataggatgggaccaagcacagttttcactccttttcatttacatgaactataatttgagattttctgtcataaacaggtcactgagtcagtatttattaatcacttgttacttataccatacactgggacagaagcaatgtgggatgcagagaggggagagaaagaaagagacagcgagagagagagagaaagaaagaaagggaagaggagagaagagagagagagattggccctatcctcaagaagcttgccatctaattggtatggctggtccaccttgtagagccacacttgagagatgccatacacatgccacagatggttggtactgttaagctctgtagaaggagacattaatgtgggttggagtgatgagagaaggcttcctgaaagaagtggtctgtagcagaacctaggtgaacctaggtggaaataaaatcaaatggataggagtgggaatgccaggaagtatgttggaaggaccttgaaataggttggagatggttgggagacctttgtgcaaatcagactgtggagggccttgcatgtcagacaaaatagtttgttaaatgaatgtttaacagacatttgttgagcgcttactatgtgccaagcactcttgcagccactgggggtagagcagtgggcaaaatacaaaaaaatccctatcctcaaggaaattgaattctatttggggaaatagatgaaaaacaaataagttagttgtatgatcagataatgtgaaaaaacaaagaagggggcataggaagtgtcatgtgtagggggtagtggctacatatttggattttgaaatttttcatttagatagctgacagccattgacaaacttctcatactatgttttggcatggtgtttatccttgcgattgcctaagagaaggagagctttagaagtgagaagtgagtcttggagaggcttagaggcaggtaggaagctctagggcaagtgggagccaggtgtagcctctgagtcttgcagctgtggtacagtggaaaaagcactggatttggatacatacactttgaactctggcaggaaccttaggtcacttcacttctctaagctttgtttcctcttctgtatagtggggataggagcacctaaccaacaagtgttatcaagattatttgagaaggtgaccacatagttggaagtaaagctctactcagcaaatgtaaaagaacagaaattataacaaactgtctctcagaccacagtgcaatcaaactagaactcaggattaagaaactcactcaaaaccactctactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaatagaaaccctaacatcacaactaaaagaactagaaaagcaagagcaaacacattcaaaagctagcagaaggcaagaaataactaaaatcagagcagaactgaaggaaatagagacacaaaaaacccttcaaaaaatcaatgaatacaggagctcgttttttgaaaggatcaacaaaattgatagaccgctagcaagactaataaagaagaaaagagagaagaatcaaatagatgcaataaaaaatgataaaggggatgtcaccaccgatcccacagacatacaaactaccatcagagaatgctataaacacctctatgcaaataaactagaaaatctagaagacatgggtaaattcctcgacacatacaccctcccaagattaaaccaggaagaagttgaatctccgaatagaccagtaacaggctctctgaaattgtggcaattatcaatagcttaccaacaaaaaagagtccatgaccagatggattcacagccgaattctaccagaggtacaaggaggaactggtaccattccttctgaaactattccaattaatagaaaaagaaggaatcctccctaactcattttatgaggccagcatcatcctgataccaaagccgggcagagacacaaccaaaaaagagaattttagaccaatatcctcgatgaacactgatgcaaaaatcctcaataaaatactggcaaacggaatccagcacatcaaaaagcttatccaccatgatcaagtgggcttcatccctgggatgcaaggctggttcaatatacgcaaatcaatgaatgtaatccagcatataaacagaaccaaagacaaaaaacacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacacgattgtatacctaaaaagctgcactgtcttagcccaaaatctcctttagctgataggcaacttcagcaaagtctcaggatacaaaatcaatgtgcaaaaatcataagcattcttatgcaccaataacagacagagagccaaatcatgagtgaactcccattcacaattgcttcaaagagaataaaatacctaggaatccaacttacaagggacgtgaaggacctcttcaaggagaactacaaaccactgctcaatgaaatcaaagaggatacaaagaaatggaagaacattccatgctcatgggtaggaagaatcaatatcgtgaaaatggccatactgcccaaggtaatttatagattcaatgccatctccatcaagctaccaatgactttcttcacagaattggaaaaaactactttaaagttcatatggaaccaaaaaagagcccgcattgccaagtcaatcctaagcaaaaagaacaaagctggaggcatcatgctacctgatttcaagctatactacaaggctacagtaaccaaaacagcatggtactggtaccaaaacagagatatagatcaatggaacagaacagagccctcagaaataacgccacatatctacaactatctgatctttgacaaacctcacaaaaacaagcaatggggaaaggattccctgtttaataaatggtgctgggaaaactggctagccatatgtagaaaggtgaaactggatcccttccttacaccttatacaaaaattaattcaagatggattaaagacttaaacattagacctaaaaccgtaaaaaccctagaagaaaacctaggcattaccattcaggacataggcatgggcaaggacttcatgtctaaaacaccaaaagcaatggcaacaaaagccaaaatttgaccaatgggatctaattaaactaaagagcttctgcacagcaaaagaaactaccatcagattgaacaggcaacctacaaaatgggagaaaattttcacaacctacttatctgacaaagggctgatatccagaatctacaatgaactcaaacaaatttacaagaaaaaaacaaacaaccccatcgaaaagtgggtgaaggatatgaacagacacttctcaaaagaagacatttatgcagccaaaagacacatgaaaaaatgctcatcatcactggccgtcagagaaatgcaaatcaaaaccacaatgagataccatctcacaccagttagaatggcaatcattaaaaagtcaggaaacagcagatgctggagaggatgtggagaaacaggaacacttttacactgttggtgggactgtaaactagttcaaccattgtggaagtcagtgtggtgattcctcagggatctagaactagaaataccatttgacccagccatcccattactgggtatatacccaaaggagtataaatcatgctgctataaagaaacatgcacacgtatgtttattgcagcattattcacaatagcaaagacttggaaccaacccaaatgtccaacagtgatagactggattaaggaaatgtggcacatatacaccatggaatactatgcagccataaaaaatgatgagttcatgtcctttgtagggacatggatgaaactggaaatcatcattctcagtaaactatcgcaagaacagaaaaccgcacaccgcatattctcactcgtaggtgggaattgaacaatgagaacacatggacacaggagggggaacatcacactctggggactgttgtggggtggggggaggaggagggatagcattaggagatatacctaatgctaaatgatgagttaatgggtgcagcacaccagcgtggcacatgtatacatatgtaactaacctgcacattatgcacatgtaccctagaacttaaggtataataataataataataaaaaataaaaaataaaaaaataaaaaaaaagagaaggctgggtgcagtggctcacacctgtaatcccagcactttgggaggctgaggtgggcggatcacgaggtcaggagatcaagaccatcctggctaatgtggtgaaaccctgtctttaccaaaaatacaaagaattagccgggcgtggtagcgggcgcctgtagtcccagctactcgggaggctgaggcaggagaacagtgtgaagccgggaggtggagcttacagtgagctgagatcgtgccactgcactccagcctgggcaacagagtaagactccatctcaaaaaaaaaaaaaaaaaattagctgcatgtgttggcgtgagtctgcaatcccagctactcaggaggctgaggcaggagaatggcttgaacctgggaggcggaggttgcagtgagccgagatcgtgccactgcattccagcctgggtgatagagtgagactccatctcaaaaaaaaaaaaaaaaagattacttgagataatgtgaatgaaaccttcattagttgtatagtcatctacaaatatgaaaagttagcccttgtggacagtgcctgtgaaaattgtaatgctgttcttttaagtctttccaggaatctgatagtggtaattgaatttttcatgtcaacaaagtcataaatcagaattttaaatcacaaagcacagttggtacaaggcactctataagaggtactgagctagatggtgggagggtagtggtggccaaggcagccttcagggagttttctttgtgctatgtttaagtctgccagcatggaataagggaagcatgactgaggagtaggtgcttcatgcagtgtggccacactccttctgtggccttgcctctgccctttatagcaaccagtaacacacccaccaaacagaaccatgtgtagttccatgatctttctctttctttatctctgtttcctatctctttctccctttccatctcatttatctctctatgctcccccaatccccaattcattcctttacacctacttccatctgcctgaagtgctcttccgtgccatattttccaggcaaactttaagttcacatcctcagcttctgtttcccctcctctagaaagccttctctgatctttctgctgtccaagtgattgcattgaattgcagttgttccatttgagtctccttcactagaatgagttccttgagggcagggattgtgctttgtctgtctctgggtccctggttcttagtgctaggattggcattaaggaaatgcttgctgacttgaaataattgtaaaagtggaagactatatagataaccaagatttatctaggaactccttcaagacttctctatttatacatcttttatgaactgaatcataaaccacagatccagtgactgaagagcagatcagggggaggctatagaatatggtaataaggctatattgcaaagtattgcaaacataattctagagtcagactacgttatagctccttcacttcctagctgtgggacctggaaataagtcgtttcatctctctgtgcctcagttttctcatccataaaatgaagattataatagtccctactttgtagggttgttttgagaattatataatttaatatacataaaatgcttaaccaccctgggcaacataggaagaccccgtctctacaaaaaattaaaaaaaaattagttgggtgtggtggcatgtgcctgtagtcctagctagtcaggaggctgacatgggatgatcacttgaacccaggagttcaagaccatcctggacaacagaggaagaccctgcatctacatagaaagagaagaaaaagcggagacagttcctggcacctagcaagcactctgtaaatgttagctcttctcatctaagtaaaatagaggcatattcaaataaaggaagtttggaataagtctagagatcatttttttctcctcagggatccctgttctgaatctttttttcagatccctgttctgaatcctctcacctcagcctcccaagtagctaggactacaggtgtgcacctccatgccctgctaagttttaaaatatttttgtaaagagaccagttctcgctatgtttggcaggctggtctccaactcctggcctcaagtgatcctcctgcctcagcctcccaaagtgctggggttccaggtatgagccaccatgtctggcacattttcagtttttcatgattacagatagagctgctgtaaacattattatatgtttttttttgtgtgtgaacacacattatttctagagggtaaatgcccatgggcaggactgtgagctcatatatgtacatgtttaattttataagaaactgccaaaccattttctagagtggctgtgacaatttatattcccactagcaatgtataagaattccagcttctctctatccttggcagcacatggtatggccactttgttattttagccttgctaataggtgtgaagtggaatcttgactgggtgttagtttgcttttccataatgactaatgacgttgaacgtattttcaggtgcttaattgccatccatgtatctttggtcaaatatctgttcaaatattttgcctactaatgtaatttgttgttaattttctttattgaatcttatgtattctgtttacataacaaaataataaagtttagtgaatcttttatgtattctgagtatgggttctttgtcagatatacgatttgctaatattgtcttctagttggtggcttgtcttttctaaaatcgtcttatgaaaaaaattagccaggcatagtgatgcatgcctgtagtctcagctatttgggaggctgaggcagtaggattgcttcagctggagagatcaaggctgcagtgagctacgatcatgccactgcactccagcctgggtgaaagaatcagaccctgtctcaaaaacaaaacaaaacaaaacaaaaccccaaatcctcttattagggtctttcatagagcaaaatattttaattttgatgaagttcaatttatttagtgattttttttttttttttgagatggagtctcactctgttgccagcctggagtgcagtggcgtgatctcggttcactgcaacctctgcctcccaggttcaagccattctcctgcctcagcatcctgagtagctgggactacatgcgtgcggcaccacgcccagctaatttttgtatttttagtggagacggggtttcaccatgttggccaggatggtcttgatctcttgacctcgtgatccgcccgccttggcctcccaaagtgctaggattacaggcatgagccaccgtgccctggattgtgcttatggatgcctgagaatatttcacctaaccctagatcatggagattttatcttatgttttcttctagacattttagcattttaggttttatatttagatttgttatgtattttgagttatatttttgtgtatggtgtgaggtttatttagaagtttttttttcttcccccaattgtactagcaccatttgccacaacttaactgtgacaacttagaaatcacttaacctgtcatggcctcactcttcttttctctaaaatggggataataatagcatgtagttcatgtggttaaaggaaagattccagactactatttacatatataaatgcctagcacacaacaaacagttattattagtattcattttatagagtttcaaattttgaggtttaatttcatgattgacaaactttgataacatgtaatacacattgtcccttttcatcccttccaaggatgttggagtacgtgggccagtgctgaggtagggttctggtagatgggttttattgggatgatggctgaaaccacttgtagtcaagaaatgatagtagtttccagctgggaggggaactgaggccagagtcagttcaataaaggcaagagtgtgtagccagaaacacaaaatgaaaaatgaagtcatatgtgatggattaaatgggtaaaggaaaagggttctggaccctgactgtgaataaagcaagatgttggggctccctcttacagaaggaacactggtcctttattcttgtttaaaagtgtcgaacttggtttttctcttcaagatgcccttcagtactgcgttgggagcctcttgccctgttctccaaacaaattcagtctaagaccatgttttgctgtgagctctgctgctttggtgtcaaaacctggtaatgtgccagttcccctttggggaggctttctaaaacatactgctcagcagagctgaaaaggctgaagaaccttctccagaaggtgattgtgcctgtggtaggtcttggtctgggagccatttccaaagctggataccacagctactttgtccatcctcactatgctccctggcactccatgccatgtaggctccccagcaactctcctttgtctccccgagaaagagctgacagttgcaatgtcttttttttttcttaaacttcctctttgatcagtgttttgagatcctaggtgaatacgttttttgtgacaagcatgtgcaagatacgcagaaaggaagtaatgctatggaaaagttgtagtcacaaccagtgtgaccagagatcattatcagtctggtcaagtcactcctgcttggagtagtgtcactggaaactgacactgcaattgacatggtctttgagcttccagatgtggcaaaacaaatgttttattgtacagcaccgaagacacaacttagtttggtgttttatgtgtacatctccaagataataatggcacctgacttcagcccttcgtagtttagaaagtcctgtcatgtttcctatttaatttgattcttacaataagaatgagagagataggacagggattattattcatgttttacagatgccgaaactgtcagggaggcagagttggaggggtacacagtggtcaagagcataggttctgaggcatatttcggtaaaatatataacaacatttttgattttgaccatttgtaagtatacagatcagtggcattggttacattcataatgcaatataacccactgtgcccggctgtggatttctgttgatgtggaaatatagttgttccagttccatttgttgaacagactcttctttctctgttgaatggatttgccttctgtgtcgatttttgacctaaggtctcttttgtctgatattagcagagccacttcaactctcttttggttactattttcatggaattgctttttgcatcttttaagtttcaatctatttttgtctttgggtcaaaagtgagtctgttgtagataacatatacagtcatgtgtcacttaacaatggagatacatgggtgggcatggtggctcacacctgtaatcccagcactttgggaggccgaggtgggtggatcacctgaggtctggagtttgagaccagcctggccaacatggtgaaaccccgtctctactaaaaatacaaaaattagccgggtatggtggcacatgcctgtagtcccagctacttgggaggctgaggcagaagaattctttgaatcctggaggcagaggttgcagtgagccgagatcgcgccactgcactccagcccggcagcccgggtgactgagtgagactccgtgaaaaataaacaaacaaacaaaaaacggggatacattctgagaaatacgtcattaggcaattttgttgttttgtgtattgacacaaacctgtatggcatagcctactataaacctaccaaggctatatggtacagtctattgctcctaggctacaaacctatactgcatgttactgtactgaatactataggtaattataacccaacagtaagtatttatatatccaaacattgaagagggctgggcacagtggctcatgcctctaatcctggcattttgggaggctgaggcgggtggattgcttgagcccagcagttcaagaccagcgtgggcagcatggcaaaactcggtctctataaaaaaacacaaaaattagcctggtgtggtggctcacgcctatagtcccagttactcaggaggctgaggtgggaggatcaattgagcctgggaggttgaggcttcagtgagccgtcataacgccactgcactccagcctggctgacagaacgagacctttttttggaaaaaaaaaaaaaagaaagaaaaagaaaaaacttgaaaggtataggaaaaatatggttatataatgttatggaaccactgttgcatatgtggtctgtcattgactgaaacattgttgcatataactgtagttagatcctgctttttaatccatattgtgggtctctctgcctttgtattgcagagttcacaccatacatttaaagtaattactgataaggaagggcttacttccgacattttggtttttgttttctgtatatcttttaacttttacatcctcattttctcgattactgccttcttttgtattaattgatttttttgtagtggaccgttttgagtcccttcttctttttatgtttatattttatttgtggttaccatggggattacttttaacatcctaaatttataacaaatgagtttgaattgataccaacttcacacttataaaatacaaatctccactcttttacagctctgtcccctctcctgtgtattgttgtgacaaattacatctttctacatactatgttcaataacatagatttataattattttaaagcacttaaaaacaaagtaggatataaaaaagtagagttataaacaaaaagttcgataatgctggcttttatatttgcctgtgtagttacctttaccagagatccttatgtcttaatgtggttttgagtaactgtctagcatctcttttttttttttttttgagacggagtctcactccattgcccaggcttgagtgcagtggtgctatctcagctcactgaaacctccacctccccggttcaagcaattctcctgctttagcctcccaagtagatgggattgcaggtgtgtaccaccacacccagctaatttttgtagtttttagtaaagatggggtttcaccatgttggccaggctggcctcaaactcctaacttcaaatgatccacctgccttggctgggatcaccttccaaagtgctgggattacaggtgtgagccactgtgcctggccggttgagcatctttttatttccactcaaaagattccctttagcatttcttgtagggcaggtctattggtaatgaactcctgcagcctttgtttatctgggaaggtcttactttctccttccgttttgaaagaccattttgccagatgcagaattcttggttgacaggttctatatatatatatatatatatatatatatatatttcagcaatttatgccatcccactgtcttctggcctctgtagtttctgatgagatattggctgttagtcttaatgaggagccttatacatggtaagttgcttttttcttgcagctttcaagactgtctgtcttttgacaatttgtttataggatgcctcagtgtggatctctttgaatttatctttcttgagtttaagcttcttagatgtctagattcatgtctttcatcaaattggggacatttttggccattatttctttaaacattccttttgtccctttttcttcactttctggcagtctcacagtatgtaattttgtctgcttgatgatgtctcaatgacccttagactgttaatctttaatttctctatcttagtgatattgtcattttcctgattttttgttctgcatgttttcctttagctcttttagcatatttaaggcagtgtttttgaagtctttgtctactaaatctgatgtctggacttcctcaggaacagtttcagtcagtttattttgttctttgagtaggctgtactttcctgtttctttgtttgtcttgtgatttttttgttgttgttgaaaacaatgtttgaatattataatgtgttaaccctggatatcatattctctcccttctccaggagttgctggggttttttctgtggttgttgttgttgttttgtagagatgaagtcttgctatgttgcctgggctggttttgaactcctgatctcaagtgatcctcctgcctcagcctcctgagtagctaggactaagagatgactagatttttttttttcgaggagtctcactctgtttcccaggctggagtgcagtggtgagatctcggctcactgcaacctctgcctcccgggttcaagcgattctcctgcctcagcctcctgagtagctgggactacaggcacgtgctaccatgcctggctaattttttgtatttttagtagagatggggtttcactgtgttggccaggatggtctcaatttcctgacctcgtgatccacctgccttggcctcccaaagtgctgggattacaggcgtgagccactgtgcccagcaattttttcttattgttaaaattcttagtagtattttggtttacttacttttccaagctacttctgcaaagactatatcttgtcctgtatggtcactgaagtctctgttccttaaattgtgttcagtgagaattttgacacagagtttctgaaatacaaggagctaaaaacaaacaaataaacaaacaaaaaccacctctactcatctttcctgattggttgtgtgtgtgggtactccttcagcacttagccagacttgcattgcacttataaactagctcaaggtgaaagcttagtcctctcaggaattttctgagtatgcttgttttctggggcatgcatgtggctttctaaattccccatatacatggttgcgtttttttttgagatgggggttctcactgtgttgcccagactggagtgcagtggtgtgattatggttcactgcagcctctgcctcctgggctcaagtgattctctgcctcagcctcatgaatagctggaactacgggtgcacaacaccatgtccagctaatatttgttttttgtttttattatttgtgctgatgaggtcttgctatgttgcccagggtggtctccaactcctgacttcaagcgatccttctgcctcggtctcccaaagtggtgggattacaggcatgagccaccatacctggccagcagttgcttttgaacgtcctcattgtccaaggaaaccattcatctgccccccatcagctttttctcccatgtcttagccagtgtattgtttgtttcaactataataatatggcccagacatctgagggttattaggtcagcgtgcagtgtttttgggcactactcaccatttctagcttgagttttgtattaggtaaaacaaacacaagtgcctggccttagttcttcaggtagcctccagactagtttgaacagttgtgtattagtctgttctcacaatgctataaagaactgcccaagactgggtagttcataaaggaaagaggtttaattgactcacagttctgcatggctggggatgcctcaagaaacttacaatcatgaccgaagacacgtcttcacagagtggcaagagagagaatgagtgcccagtgaaggaggaagccccttataaaaccatcagatctcatgagaactcactcaccagcccaagaacagcaggggggaaactgcccccatgattcaattatcccttgacaggtggggattattacaattcaaggtgagatttgggcgggggcacagagccaaaccatatcaagaagtatacaataatttgtatttaaggtttgctctattccctctggaatcagggtacagggttgcacactgggaacgtaggctaccatcactttaaaacaaaaaatgccactgtgctagagaaagggtgggttaaaggcaagtaaaaatgccacaaaactttcctaccattttgaggtgacctgttttatgattcagcattcacttgggtcacgtaaagttttgacttttttccagagttcaataaagttgattctgagagtttctgcttgtgttttttttttttttttcccgagacagagtcttgctctgttgcccaggctggagtgcagtggtgctatctcggttcactgcaacatctgcctcccgggttcaagtgattctcctgcctcggcctcctgagtagctgggattacaggtgcacaccagcacaccctgctaattttttttgtatttttagtagagacatggtttcatcaggctggtctcagactcctgacctcaagtgatctgcctgcttcagcctcccaaagtgctgggattacaggcgtgagccaccatccccggcctctgcatgtgtttttgatgtttctgtgggagaacaagagcttggagcttcctggtccaccattttgctgatgtcactctgactactctttttaatccacactccctaacttacagtagcgtcctggctccactctgtaaccttgaactagttacttaacctctctgttttctttagtgcaaagttgggtataaagatagtacctacctcaaaggatagttgtaagaattaaataacataattcatgtaaagacattagtatagtgtgtggtaagttaagtgctcaataaacgttagttatctttggaaattacaccataattatatgtaccactaagaaagaacaaaatgtcagttagcatgtggcatgccattgatagtaaaatgtatcgtaatttcaaaaatgttaaaatgtaaaatatgatgactgggcatggtggctcaaacctgtaatcccagcactttgagaggccaaagtaggaggactgcttgaggccgggagtttgagaccagcctggccaacatagtgacaccctgactctacacacgggcacacacatacctgcacatacacacaaattaattgtctgggcatagtggtgaacacctgtagttccagctacttgggaggctgaggtgggaacattgcctgagcctgggaggtcaaagctgcagtgagccatgattatgccactgcactccagcctgggagacagagtgagaccctgtctcaatttagaaaaaaaagtcaaataggtgtattttacaactgattaattatcatatcaccatcattatcactatgattgccaggcctcacctggtgcaggttttacattttgcaggcaaggcagctaggcctagagatggtaagtgacttgctcatggatttgtaggcatttatgtcatagccagatctggatcaggttccctgactcttattctgggtacccagagagactggggccccagtctctcacaactagtagtttatattataaatactattctgttatgtctcactgttgtaggtgtgttagattttcgtcagcaatgtgctcaaagtgagaagaataggaggaatttgttttttttttttggagaaaaagttgctgaagtctagctgggtaagttgagtcttttctgagagcatgagtgtgggattaaaaatcagatgtcactctcttgccatgagaccttggatagtcacttagtctctttgagccaaacagtgttagaaatctccaaaaaaaaaaaaaagggaataattgctactccatagagttgtttcagagtgtgaaatggcatcacttctaagaatactgcctggcacatggtagatttccactcagtgttggttctcttttctactcctttgagagaagtgggctcagtgacattctccctgctcagctcaaactttgtttatgtttatgagtgtgtagaattagatcaacattgttctctgtggcggatttgttagtggctgagggaaaggtagcagctggatgctgtaattctctcgagagacattcctactgctgagtgaggaggagagcacagctgtttgtggaaaatgaacaaaatggtaattgcctcgtgtcagctggtacattctgagacttttgctcttgttgatgttttcttcagtggctgccttatgttaaacatgcccctacccatttgctgcactggtcttgttccagcttcttcaatatgctacgtaggctctttcatctcctataccttgctcacgtggtttctctcaaattccaattttttttttttcctttttgtacctagcaaactcctacatatcctttaagtctctgctcaaatgtcatttcttttgtaaggccttgttgaatgactcttttgaagagtaacattattcctatatctggaaccgcatggtataatttatttgtttaaatgcatttctcctctattagcgtctatgttcatttgaagacagtggccatgtttatttcttctttgtattgcacaggcctagcacatggagcagttatcatagctgaagtttactattgtccatattatctcacaggctttcacactcaccctgtaaagtagatactgttgttattcccattgcacagatgaggaaagtgaggattagagaagttaggtaaatcatcaaggatcacagggcaaggtgattgaggagcatgtagtagaaatttgttgtgactccaaggtcatgctgttaacctctgtgctctagcatggtgcagtccaatagaactttctgtgattatggaaatgtctgtgtgttctttgcaatatagctactgagcacttaaaatttgcctagtgtgattgatgaaatatatttttaattttattaaattttaatgagttgaaatttaaatagccacatgtagaaaactgaactctgatctcttaatggctgtctagcattttcttttagccttaactcagaatttctctcaactgttcttatttcatcaattactctattaaagaaactgaattacatcctgatggaaacagaatgatctccttttcttaagacagttatgtatcttttagcagtctatcgttattatttagagttggtgttaaggctgtagaaattggaaaagttgttgggaataaatgttgtcatcactcttaaacccagttttcgactatattaagtataaagtacaaagatgaaacagattgcaatagatttctgggggaaaaatgttacttctctggctaacacacaaataggcaaaaataattattccaaaggaagtttaaaatcacagggatactacagtctagaagtgtcccatcaaagacacttgctgttgggctgaaggaacaggaagttatgaaaagcactcagtgcctaaagtcactgttgacatgtcaagaggtcctagagaataatccaagacaggctgttcttgtgggtagatgttagagatagatgaagaatgcgttcttattaatcattgagaaaatccagtctctcgtacagcatatgcattgaataagaactgggcatgttcaaggaaccttagtgctcaaagaattctttgggctcttcttgtatttcagttcacacatattttaaaaacattagtatggaaaatttcaaacatacacaaaaccagagagttttaatataatgaaccctctagattcatcacccaactttttttccaatctcatttcaggtaccctcaattcccccacccaaaacacacatggtatttttcttctggagtattttaaagcaaatcccaggtatgtcattatacccatatatatttcagtatgcatttctgatacggactgttttagtatatataaccactgtgacatcatcatatgcaatacaaattgtcagtaatttcttactatcatccactagccagtctatacctatactctcccaattgtttcaaactgtcttttttaaaaaagttaacagccaggcatggtggctcatgcctgtaatcccagcaatttaggaagctgagtcaggcagctcatctgaggtcaggagtttgagaccagcctggccaacatggtaaaaccccatctctactaaaataaaaaaaaacatagctgggtgtggtggcacgtgcctgtaatcccagatacttgggagactgaggcaggagaattgcttgaacctgggaggcagaagttgcagtgagctgagatcgtgccattgcactccagcttgggtgacaagagtgaaactctgtctcactaaaaaagaaaaaaaagttaatagatcctatttttaatttttttattatttaaattttttttaaaaaaatttgtctttgagatggagtcttgctctattgcccaggctggagtgcagtggtgtgatctcagctcactgtaacctctgcctctcagttcaagcgatcctcatgcctcagccacctgactagcttggactacaggcacgcgccaccgtgcctggctaatttttgtatttttagtagagatgggtttttaccacgttggccaggctggtcttgaactcttgacctcaagtgatccacccgccttggcatcccaaaatgctgggatttcagatgtgagccaccgcacccagccaagattctatttttcaaagcagtttcagtttcacagaaaaattgaggagaaagtacagagtcctcatatacctcccaagccccctcctccggtttcccctattaacatcttgcattagtgtgagacatttgttacaattgatgaaccaatattgattgctacattattattaaagtccatagtttacattagaattcacactttgaattacatgctaagacttttgacaaatgcgtagtgacatgtatccaccattacagtatcatacagaatagtttcagtgctgtaaaccccacccccaaccccgtgcctcacctagttatcccttcctctttccctttgagctcctggatgtacttcatgatgctttcatctatgtatacacgtagaacggctaaatcaagctaattaacatactcgttacctcacgtacttattttatggtgagaatatttaaaatctactttatttgcaattttcatgtatacaagacattgttattatctataatcacatgcttgacaatggatctcttgaactcattcctcctgtcaatatgaaattttgtgtcctttgaccagcatcttcccaatctcttctcatccccctgctaactatcattctactctctacttttatgagttagactttttaggattccacatataagtagatcatgcagttttcacttcctgtgcctggcttatttcactagcataaggtcctccatgttcatccctgtgttgcaaatgtcaggatttccatagcaagaacacaatcaacagaatgaggagacaacttatgaaatgggataaaatatttgcaaaccatacatatgataagagtttaatatccaaaatatgtaaggaactcaggcaactgaatagtaaggaaatgaataacctgatttaaaaatagacaaaggacctgaaaagacatttctcaaaagaagacatataaatggccaacaggtatatgaaaaaaatgctcaacattagtagtcatcagggaaaggcaaattgaaatcacaaccatataccacctcctacctgttataatcactattatcaaaaagatgaaagagataagtgttggtgaagatgtggataagtgtgtacactttgtgggaatgttaattagtatggccattattgaatacagtatgatatttcttcaaaaaattaaaaatagaactatccaaaggaaatgaaattggttgttgaagggatgtctgcactcctgtgttcattgcagcatcattcacaatagccaatatttgtaatcagctcgagtatctatcaataggtaaagaaaacgtggtatgcatacacaacaaaatagtattcaggcttctgtaattttaattgagcatttgtagggttccattttctctcagcatattaattatacttcttttaaatctttttattttattttacatatatacatatatattttttttattttttatttttattttttttttcagatggagtcttgttctgtcacccaggctagagtgcagtggtacaatctcagctcactgcaacctctgcctcccaagttcaagggattctcctgtttcagcctcccgagtagctgggactacaggcgcccaccaccacacccagctaatttttgtatttttagtagagatagggttccaccatattggccaagctggtctcgaactcattaccttgtgatccgcccaccttggcctcccaaaatgctgggattacaggtgtgagccactgtgcctggccttatttttatttttaagactactcaagtgcagtagtgagaagggggcaaagagtagaacaagaagtttgatttgtaactgactgtgaacaatcagttgagataactcactaccctcagaccagcccttcttttaaaactttttttggtgtttgccctagagtttgcaatgtgcatttagaaagagccaaatctattttcaaataacgctacactatttcacaggtagtgttagtatcttatagcagaagattaccaatttctttctcgagtcccttatgatattgttgtcattcatttcagctatccatgcactgtcatcactgaatacattgtccctatcattattttaagcaaatggtcatctgttttttgtttctgtttttggtggtttttgtttgtttgtttgtttttgggtggagccagggtcttgctctgtcacccaggctagagtgcagtggcatgatcttcactcactgcaacccccacctcccgggctcaagacatcctcctacctcagccttccgagtgggtgggactaccggcatgtgcctggctgattttttgtatttttggtagagacagggtctcactatgttacccatgctggtcttgaactcctgagctcaagcgatcctcccacctcagcctctcagagttctgggattatagttgtgagctactgtgctggttatctattttatcaacagctggacatggtggcttatgcctgtaatcccagcactttgtgaggttgaggtgggaggactgcttaagcctaggtgtgaggcaccacggggagttcaagaccagcctgggcaacataatgagactctatttctacaaaattttcaaaattagctgggtttggtgccgcgtcactgtagtcctacctacttggaggctgaggtgggaggatcacttgaacgcaggagtttgagactgcagtgagctatgatcgtgacactacacttcaacttgggagacagagtgagatctcatctctaaaaaagacaaaacaaaacaaagcacctcgagccactcattttaagagttgagctgatttacgtagtgctacccaactatattttcctgtatatgtaattgcagacactgttctaagcactttacacatattaacttatttaatcctcacaggaaaacttataaggttggtgctgttaggatgaccattttacaaaggaggaagctgaggaacagaggggttaagtaacttgcctaatgccacagagcaattacatttcagcctggtgatttgaacttaggcattctggctctcatgctgtactaggcaattctttttttttttttttttttttttttttgagacggagtctcgctctgtcgcccaggctggagtgcagtggcacgatctccgttcactgcaagctccgcctcccgggttcacgccattctcctgcctcaacctcccgagtagctgggactacaggtgcccgccaccatgcctggctaattttttgtatttttagtagagacggggtttcaccgtgttagccaggatggtctcaatctcctgacctcgtgatccgcccaccttgatctcccaaagtgctgggattacaggcttgagtcactgcacccggcctgtactaggtaattcttagctggtggtgagacatcactactaaatgtggatgggatgggatgggatggatatgttatttcttgggtctctctataaactgttccaggaggctcacgccccagggaaatttcctttcaattgtctcttatattttccttctatgatcttttgtgctgcctcacaaaaacagaaagccattagtttcatcttctagccacatatgttcataaaagctgtaaaacccatgagtatgagatgcttggaggcttgtagttattgtaaataatttacaaatccatatgtaccccaaatttttctgcagaataataatgtgtgcactattaaaaaatattaaaaattacagctataatcatatgagagggtaaaaaatattgagaggtatgaaaaatagttcatcatacataataggaggtaaatgttgctcaagagagagggtgattgtgaattaaattttttaaaaagcagagataagtaaaaacaaaaaccttgggttaaaaaggggaatcctagccacactggctcttccagatgagaaaactttttccaaactgtagaccagggctgccattttgagagaatagaaaatgatgacatttgtgaactggtagtcagaacactagcattgggggcttttggcagtggtagtcttggatttgaaccacatttccactgcttaacagtcgtgtgatttgggacaagttactcaatttctccaacccttagctttcttatctgaaaaatataattcctgacctacaaagtaaaccacaaaataggtcacccagcaaataaagtggccaagaacttgagttttgatggtatgaagtcataaataagattatggatgtaaaagtgcctaacacaaaactagatatttgacaaagtaagaatcctctaaaggcattagtcaaagagcttagtattagtatggtagacaacagtgacttgggaattactatgttgttctagttgatttcttaacagctttgacctctttatatcatttggaaagaatcaaatggacctcaagaggttatttagttctgtgctctgcctcttgtcagacaaacttcaaaattcagtattccctttgttataaatcctgtttgaaaagatatctaggaaaacgagcacatgacctcccaaggtagacagtccctgtgtacaatgacttataagccaaattgactatttattttctttctttcttcattattattattattactttttgaaatggagtctcactccattgttcaggctggagtgcagtggtgtaatctcgactcactgcaacctccccatcctgggttcaagcgattctcgtgcctcagcctctcgagtagttgtgactacaggtgtgcagcaccatgcctggctaattttttattttattttattttattttattatttttttttttttagtagagatggggtttcactatgttggccaagctggtcttgaactgctggcctcaattgatctgtccctctcggcctcctaaaatgctgggattatacgcgtgagccactgtgcctggccctaatggactatttcttaatgtaattagtacttgctacttattgcttgggtccctaaatagtatgttttcatggagtaaccaacttttctggcctattttggcctttaaatattatctatctcaataaaaacagtcaaacaaaatcaacaggcatcttaacaaaagcttgtggaagtcagtgtggcgattcctcagggatctagaactagaaataccatttgacccagcaatcccattactgggtatatatccaaaggattataaatcatgctgctataaagacatatgcacacatatgtttattgcagcactattcacaatagcaaagacttggaaccaacccacatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacgccgcatgttctcactcataggtgggaattgaacaatgagaacacatggacacaggaaggggaacatcacacacaggggcctgttgtggggtgggggcaggggggagggatagcatcaggagatatacctaatgctaaatgacaagttaatgggtgcagcacaccaacatggcacatgtatacatatgtaacaaacctgcacgttgtgcacatgtaccctagaacttaaagtataataaaaaacaaaacaaaagcaaaagcaaaacacagatacactctgttttgctgagagctagagaaatgctgcggaaaacctagaagtagctgtgagaatatatatatcctggctgatttaggtatcattcacagagcaaataattcacctacttaaattgtacaattcactgagttttagtatattcgcagagttttgcgaccatcaccacaatcaattttagagcattttcttcaccctaaaaagaagcctcataccaaataacagtaactccttattttcccccattcctgctagcactaggcaaccacaaatctttctgtgtctgtagatttgcctattctggacattttatataaatgggatcatacaacacgaggtttttcgtgactggcttctttgatttagcataatgtttaccaggttcatccctattgtggagactgttttaaaaaatctctgcatttggaggtcagacctcagtgtattcagaagggctctccagagacttagaaccaataggatatgtatctatatatatatacagaaagaggggcctggcgcagtggctcatgcctataatcccagcattttgggagaccaaggcaagtggatcacttgaggtcaggagtttgacaccagcctgggcaacatggcaaaaccccacctctactaaaaatataaaaattagccaggcgtggtggcaggcacctataatcccagctcctcgggaggccaaggcaggagaatcgcttgaacccaggaggtggaggttgcagtgagccaagatcataccactacactccagcctgggaaacagagtgagaccctgtctcaaaaaaaaaaaatattttaaggaattggctcatgtgattgtggaggcttggcaagtccaaatacctaatgggagaggcaggcaggctgaagactcaggaaggagttgcactttgagtccaaaggcagtctgctggagaatcccctcttgcttgggggtaaatcagccttttgttctatttaagccttcaactgattggttaaggcctacccacatcacgagagcaatctgttttactcaaagtccactgatataaacataaatctcatccaaaaacacccctacagaaacatccagaataacgtttgaccacatatttgggcaccgtgccccagccaaaatgacacataaaattgtaacatttggcgattttttttttttttggaagaagtcttgctctgtcacccaggctagagtgcagtggcacaatctcggcccactgcaacctccaccacccgggttcaagcagttctcctgcttcagcctcccaagtagctgggattataggcatgtgccaccacccacacccagctaattcttttatttatttattttttggtagagatggggttttgtcatgttgaccaggctggtcttgaacttctgacctcaggtgttccgcccacctcggcctcccaaagcgctgggattacaggtgtgagtcagcacctggccacacttcgctatttttatcctgtgaataggtaaacaaacctaacattgaggattgtctttcttggaagcatatgcaatttaaaattagcaccagcaattgctgtattttgaatctctttgtgtaaacaactactctgagataaagaatgacttttgaaatgacccagaaagaatatggatcttgcacggtagcctcaaagctaagtaaagaaaggagttcttttctgtcttcttgaaataggaaaatatttcatcttgaaactatctgagcctttcttcctgccctggatagcctatatcagcatatgaactggagagagagagattaactacatgtatcagccagaaactcaaatgatcaaatgtcaggactaccttcaggttttattggtctacgttccacagcagacattaatcttccacaatggacagatgcaatgttttatgtacttctgtattttatccctgcctctgtcctatgcaatttcctttcctactttcttaaaatgaattcgttttcttgcagattctagatgcagttattaagttttctgacacaactagaaagattttcctttgtctctgcatttcaagagaaagcttctctagtcacagtcatgtaaaatgtaaaactcttgagtacaaatgaaggaattctgcagagcttaaataaatacaggctgactaatatgtaggggaaactagcctagtcactcagagtctccagtctgatgccactgagttataggcaccttcctgggcccaacagttgggtttatgaagacaggatctggatgtccattccaggccccagaatatttacctaagatatatgtactcataaaatcagaaagaatatttgactgcagataggaaataattagggatgagcagagccttatgatcacagaggtagtgggaggtatggccagaatttgaactacaaactcagtgttctttctatctcatcatgacgtttcttttagttttttttttttttttgagacggagtctctcgctatcacccatgctggagtgcagtggcgtgaccttggctcactgcaacctccgcctcctgggttcaagtgattctcctgtctcagcctcccaagtagctgggactacaggtgtgtgccaccacgcccagctatttttttttttagtagagtcggggtttcaccatgttggccaggctggtctcaaactcctgaccgcaggtgatctacccaccttggcctcccaaagtgctgggattacaggcatgagccaccgcgcccgacttttttttttttttttttttttttgagatggagtcttactctgtcgcccaggctggagtgcagtggtggtgtgatctcggctcactgcaatctctgcctcctgggttcaagcaattcttgaactcggtctcggtctcccgagtagctgggattacaggtgtctgcaaccacgcccagctaatttttgtatttttagtagagatggggtatcaccatgttggccaggctggtctcaaactcctgacctcaagtaatctgccagcctcggcctcctaaagtgcagggatcataggtgtgagccactgagcctggccttatcataacttctcaaacactgctcaacaatgccttgtccagagacattatcaatggctaatatcattttaatgctcttttattaaactatgtatatactgagtttgtataaatagtggatttaaaatgagtatctgtgaataggaaccttattctttgaaataatgtactctaactttttcgatttcagcatctgttttgctgagtcttcatcactatggtctaggatgttaagtcaataatattgaaaggtctgcctgtatattttgttttagtactaactttttacaatattatattttaggaagaaaaaaagactaatttatgccttgtggtgtagctcctttgagtgtatattaaaacagtcatggttgctgaaatgaagaaattgagcaatggaaattgtgaaagtagaatggaatcttacaaataagttaatatgagaaataattataaggtattatcattttcttgattatttgatcttattatgctttaatattctacaaaagcatttgtcattttaagtaggaaacaaaaacagcataaatttactttttacacgttatttatttatttatttatttaaggtggagttttgcttttgttgcccaggctggaatgcagtggtgtgaccttggctcattgcaacctcctcctcccgggttcaagcgattctcctgcttcagcctcctgaatagctgggattacaggcacccgccaccatggctttttttttttttttttttttttcctgtagagacggggtttcaccatgttggccaggctggtctcaaactcctgacctcaggtgatctactcgcctcagcctaccaaagtgctgggattacaggcatgagccaccatgcccggcctactttttacactttaaataggtgaattttatggtatatgaagtatgtctcaataaaagtatttataagaacctgcacttaatctccctgttgttctgatttttcttaatgcaccttctttttttttgtttgagacagggtctctccctgtctccaaggctggagtccaggggtacgtgcgttcatggctcactgcagcctcggcttcctgagctgaagtgatcctcccacctcaacctcctgagtaactgggaccacaggtgcaagccaccacgcctggctaattttttgaatttttgtagagataggatcttcctatgttggccaggctggtctcgaactcctgggctcagcaatccactcgcctcagcctcccatagtgttaggattacaggcgtaagccactgcaccgggcctgatacacctttcttctgaagaaacttttctttccctctgtggatgacttttttcccttcttaccataaagcattgagatgttcctcctgcttcgttgctctttcctataactagttttaaaaatagttgtctaaattttagagaaagtaaaaccctttctagttctgacattggaaggactttatgaaggattttgtgctttagtttcatcaaagtctcccaatgaaacctaagttgctttccattctaagcctggtgtttattttaataagtgaatgttttcccatagctgggggaaacatctaggcctcattctcctctttctgccaataaatatgttataattgtagctccagtgatactatttctttacattaaggtgaaagcttacaagaaatgcatgcatagcaaatcattgggctttgggatcaaagcactgtccggctgataatctagtttccatcaaatagtgatgtgttttgaggagggctgggtgttttttttttttcatttcttttgttaattaattgtaataaaagcctctaaaggatttttctggagactgtctaccaaatcttctgaacagggaaaattttataggaataatattaatattctttggaaaattttccaaagtttaagccccttaagaaggttttaccttctgggtgcggagttggatttaacaaacatttctggctgggcgtggcggctcacgtctgtaatcccagcactttcagaggctgaggcgggcagatcacgaggtcaggagatcatcctggctaacacggtgaaaccccgtctgtactaaaaatacaaaaataaattagccgggcgcggtggcgggcaactgtagtcccagctacttgggaggctgaggcaggagaatggcgtgaacccgggaggtggagcttgcagtgagccgagatcgcgccactgcactccagcctgggcgacagagcaagactccgtctcaaaaaaaaaaaaaaaaaaaaagaaaaaaaaattagccaggcgtggtggcaggcacctgtaatcccagctactcgggaggctgtggcaggagaatggtgtgaacccgggaggcggagcttgcagtgagccgagatcgcggcactgcactcccgcctgggcgacagagcaagactctgtctcaaaaacaacaacaacaacaacaaaaaaccagaaaaccaaacatttctttggtggctgctgggaggtcctgtactagacccaggggatggagagatgaagcaaccacagtgccagcctacaggtgtcccacggctggatgagagagacagggtaattcacaaccagctgtgctttggtgaccatgtttagtgaaccaaatttggaatatatggtcattattaatagcagtgtacttatgtgcttatggtaacaatgagatggaatattttaaactggggccttccttattttctgggatatatagtatcatatacagataaatcgaaattttgtgactcttgttcaagagtactcctgagtttacagtcagtggtgaggtaagaggaaacagtgttactgacttctttgcttttttcttactcctcccctgacattttcaggtgggtgaaatctggttgaggggacatcaaaagaatttcagaaaaataggccaggtgtggtggctcacgcctgtaatcccagcactttgggaggccgaggtgggtggatcacgaggccaggagttcgagaccagcctgaccaacatagtgaaaccccgtctctactaaaaatacaaaaattagctgggcgtggtggtgctcgcctgtaatcccagctactcaggaggctgaggcaggagaatcgcttgaacctgggaggcggaagttgcagtgagctgagatcatgccattgcactccagcctgggcaacagagtgaggctcatctcaaacaaaacaaaacaaaaaacagtttcagaaaaataaagtcactaaaagaccctgtgtggtctaaggggtatgaaaatatggcagaggcagctctatgccctagtaacacttggcattttaaaggctttttttgacctggtgcaatggcccacaactgtaatcccaacacttggtaggccaaggtaggcagactgcttaagtccaggagtttgagatcagcctgggcaacaagtgagaccctgtctctataaaaaatttaaaaattacccaagtgtggtggcatgtgcctgtagtcccatctacttgggaggctgagtgggggaggatgtcttgagtccaggagttcaatgctgcagtgagcactctagcctaggtgatagagcaagtctctgtcggaaagaagggaggaagggaggaagggagggagggagggaggaaggaaggaaaggaggaagggaggaagggagggagggaggaaggaaggaaggaagggagggagagagggagggagagagggagggaggggagagagaaagaaaaaggaaagaaagaaaagaaagaaaaagcaagcaagcaaaagaggaagagaaaaagaaagaaaggcaggctcttcctactatgtaaatatgatttggttattcactggttgttaaaatagttcatagtttgaaaattaaacttattaaaaattatttattttgttgatacataatagatgtacatattttcaaagtacatatgataatttgatactttcatataatcaaatcagtgtaattaaggtatccatcaccttacatatttaactttcttaatgctaggaacatttgaattgttgtctcctagctgttttgaaatgcacaatagatttttttgtattttttaaaaattatactttaggttctggattacatgtgcagaacgtgcagttttgttacataggtatacgcatgccatggtggtttgctgcactcctcaacccgtcacctacattaggtatttctcctaatgttatccctcccctagccccccaccccctgacaggcccgagtgtgtgatgttcccctccttgtgtccatgtgttctcattgtttaactcccacttatgagtgagaacatgcagtgtttggttttctgatcttgtgatagtttgctgagaatgatggtttccagcttcatccatatccctgcaaaggacatgaactcatcctttttttatggctgcataggattccatggtgtatatgtgccacattttcttcatccagtctatcattgatggacatctgggttggttccaagtctttgctattgtgaatagtggcacaataaacatacgtgtgcatgtgtctttatcgtagaatgatttataatcctttgggtatatacccagtaatgggattgctgggtcaaatggtatttctagttctagatccctgaggaatcaccacactgacttccacgatggttggactaatttacactcccaccaacagtgtaaaagcattcctatttttccacaacctctccagcatctgttatttcctgactttttaatgatcaccattctaactggtgtgagatggtatctcattgtggttttgatttgcgtttctctaatgaccagtgatgatgagcattttttcatatgtctgttggctgcataaatgtcttcttttgagaagtgtctgttcatatcctttgcccattttttgatggggttgtttgtttttttttcttgttaatttgtttaggttctttgtagattctggatattagccctttgtcagatggatagattgcaaaatttgtctcccattctgtaggttgcctgttccctctgatgatagtttcttttgctggaaatgcacaatagattaatgttaattaatctatccagcatcaggtcttaggaaatttaaacttctttagatggcattcaagctattcacagtttgtcttctatttgtaccacttctccagttttatcttctatttctcccctccacacctcctacttgccaaatgcattgggttctcagaatatttctaatttccttttggattccttgtctatttatctgctgtttcctctgcctggaatttcctcctccattctcacctgtgtgaacatctccttatccttgaagtcatagccaaatatctgtcactcttctgtggagcctttcctatgccaaaacaattactctgttgttcgtctttgtagccctagtgcctatcacaatgcttgtcaccaaataggtgctgagtaaacattttgcatgaggttcattcgttttcatactataatagcaaatatgctccctaaggaaatttgaaaaatacagaagaatataaataagaaagtagcaatcatgcacagccgcagtaacaaccactttttttttttgacatattctagtcttttctaagtatatcatatattttgtagatggttgagattgttttggtaaaaggttgataaattgctctctttattacttctttccactcatgtttcatgatcccctgatggtcttcttgctctggctgtgttcatatagttatattctctttcctccccatcttccacttgcacacttgctagttccctcctcaaaaacctaattagatgtgtttctctttgttggctatgtcctccaccttcactaaccttgtttttcatcaaaacctgttatcaaaccaatagtcacaatgagttttgcatgattgaacccatctacttctctacctgatcctctaacactgatggaaattaaatatggatatttaagctgtaagtgaccttggggaggctagtcctcccttgtcattttcagataactcatgtgccccacacataggtggtggtaagtgtgtagtagggccctccctattcctagccttttgttcttactgaggtcttatagctggtaattggcagcatcaggactagagtccaggtctaactgattcctaagctaacctatattccttgataggttgctctgttaaaatgttatttggttgttgaagataacttttgtctccaaaatccatgtgtcttttctctcttaccaaagtgctttgcaaaattaatgttccccacacattagcctgactgaccaactgacccaggatagaatggttccttgctttggaacttctcccaggctcacccagagagcttcttagcagagctaggaataatattcatatcttctaatgtctagattttcagtttaggccatgagagccagctgagttctctgaggagagttcctcatttttttttaatcaggaaatatagaaatcaatatgtgagtgttagcttggcacagtggctcatgcctgtaattccacctttttgggaggctgaggcaggacgattgcttgagcctgagagtttgaaaccagcctgagcaacatagagagacctcatctctacaaaaaatacaaaaattagctgggcatggtggcgtgcacctatggtcacagctactcaggaggctgagattggaggatagcttgagcccatgagatttgatactgcagtgatctgagattgtgctactgcactccagcctgggtgacagggcaaatccctgtctaaagatataaatatatgggtgttaaaatttgatcactggcaatgttaattcaggattcacagaatcataagatgttagaactgagaggagcctttgaagttctgtagtgcagccccattttactgatgaaggaaatgaggtcctgagagggcccaaggtcacatagctgtaaatggtggggaaggtactagcaggagcctcaggcctccaatactaaaagacactggagaatatattaggcagggccacaaggtaggtgaagaagaaagtcttgggatatgtgtcttttcctctgacatattatagcatgtgtcatatttgtgaatgggaaggggtccacaaaaataacatttgcttcgtacactctagttctgtgttgtatatacacatgaaggattgtcacaaggtaggtaaacaaattagattgttttcccaaaagaattctcgcagagaaattgagcttactttgtcagctttttacgatgaacagaatttggagtataatgatttgggggctgtgggttccccgtgtgcaaactaatattctcagcaaacacactttgcagaaagcagctagagttgatggaaagaggtctgtcctgggattaaatactggtcctgctggaaacttattgtggacaattaatagggaccttttccctctcccagcctcagtttcctgttatgtaaaatcagagattacatttgttcatttcatggattttcttgtgctgatatcttatttctaaggtcattttttcagctttctgctgaagcagtcactcctctcagctatttgctgtattccaagagaggtctccattctctccttattgcctaattagattgttgtatactacagactgatggacatgctgtgcttttcatttatgcagaagcctttgttttctcttggatttcccagttgttttgcttctggttgatttatccttggactctattgttatttgatacagcctcctattaatagaagtttgtcttcttggtcacttctctcttcagttcatcagttctgaaaactgtgttttcattcagtgctcagaggactccactcttgctttatttaatctgagatgcctccaaatataacagtatgtgtattcaagaccatacaatttgtacctgtgttgatagttagtctctgtggtttcttttaaaatgacatttgtttatttatttatttatttgagacagagtccctttctgttgcccaggctggagtgcagtggtgcgatcacggcccactgcagcctcaacctcccaagctcaagctatcttcccacctcagccccctagtagctgggactacaggcaagcactaccatgcctggctaatttttcatatttttttgtagagacggggtttcaccgtgttgcccagggtggtctcaaactcctggactcaaaggacccgcctcagcctcccaaagtgttgggattataggcgtgagccgattaacccagccaaaaaggacatttatatactattataacattcttgtagaaatactggagaatatttttatgcataagcacagttcttcttgaattgtatacatatttgaattgtatctgggactacaggcgtgtgccaccacacctggataatttttgtatttttggtagagaaggggttttgccgtgtttcccaggctggtctggaactcctgggttcaagtgatttgcccatctcagcctcccaaagtgctgggattacaggcatgagctccccggctgatacaagactattttctaatctacagactttattcaaaatttaccaattgtgaggtttttaaaacaaatctcattttgtaaaacccacctccactgagattttgctatgaattaagtaatctctatttttggacattgagaacattatcattttttgttttggtattttgagtaatgctgtgtgcatttttgtagatataggtttttaatctcctttcaaattatttctttaagatatacattcctatggagggttattggtcaaagggtatagatattttggtggctttggtaagctgaactccattcttttgagaggaagtttacacaatgtgtgaaagcagaagtattggaatgagacagaccttgtttaaagtcctgtttgtaacatttgccagctgtgtgatctctctcaagtgtcttctacttcgagtgcttctttctttatttgaaaaaatggaaattacaatttgtactccacagagttgtttgaagtttaaatgagaaaaacttatgtagtaaatttagcacattatgacaataggtattatgattttctcctctttggattgtaaattccaggagggcagggatgttgtctatctgggtccctatgttgtctctggcacctaacacagtacttggtgcaaagaaagtactgaagaaatattaatcgaatagatgaatgtcataggttataataatttatagtaccagcagtaattttaaaactatatgtgttttcttgcagtcctataagcatagcattttattaaaaaataaaacctttctgctgtctgctattttaatgtgttcttgtctaattagcattttatgtttttattatcttttttaatttttattttttgtagggggtgtctcactgtgttgcccaggctgatcttgaactcctgggttcaagcgctcctccctccttgacttcccaaagtgctgggattacaggtgtgagccacgttgcccagtgtcccccaggctggagtgcagtggcacaatctcggctcggtacaacctctgcctcctgggttcaagtgattctcctgcctcagcctcctgagtagctgggattacaggcacccaactccatgtctggctaatttttgtaatttttgtaaaggtggggtttcaccatgtcggccaggctggtcttgaactcctgacctcaattggtctgcctgccttggcttcccaaagtgctgggattacagatgtgagccaccatgcccagctattatttcttacataaattttgcatatatattggttggggcttctcttgaatgtgccagtgagaaaatacccattggttggtcgatgaaagggatggggttttcatagatgttgtatctttcctttcttagaataacatttaaacaggttcagtgacaagcaagttaaactacacattttacctttccaaaaatggggttgacctggccaaagggttgacaacacctttggatagttcccacattcttacatcattgctaagacttactaaattgataggatctttataatggtgcttttgacacttaaatgtgtatgtgaatcacctaggatgtattaaaatgaagcctgattcagtagatctggggaacacactttgagtagcaaggctatacgccagtcttaaaggtgaaaaagtgagagagatcagtagttgcattgggttgagggatcaagggagggttctttttatttcaggatgggaattacttaagtgtgtttattgatccagtgaggttataactatgctattcatttctgagtcacaagagctattcaagacatggcaaatattgcttttctgtatacgaaggacttccatgtccatcgtttgagtcagtgtttcacaaccttttttttttcattatcatccccttaaggagactttttaggtattcttatcctcattgcaacccacatcaattcttatatgacagttttaatgagatataattcacataccatacatgtcattggtttctattatttccttcaaacccacaaccatgggcaatcactcacttattttctgtctttatagatttgatttgcctatttttttttcgtttgacagagttttgcttttgtcacctaggcacgcgaccatgtctggctaatttttgtatttttagtagagacggtgtttcaccatgttggccgggctcatctcgaactcctgacctcaagtgatctgcccgcctcagcctcccaaagtgctgggattacagctgtgagccaccatgcccagcgcccctccccccccgctttttttttttgagacagagcttctctcttgtctcccaggctggaatgcaatggcatgatctcgactcactgtaacctccacctcctgggttcaagcgattctcctgcttcagcctcccgagtagctgggattacaggcacctgccaccatgcctagctaatttttgtatttttagtggagatggggttttgccatgttggcctaggctgatctcgaactcctgacttcaggtgatccacctgcctcgccctcccaaagtgctgggattacaggcatgagctactgcacccagacttttcttcttcttcgttcttctttcttctttttttcttcttcttcgtcttcgtgacagatctcactctgtcacccaagttagagtgcattgacctaaacttgtcttactgcagccttgacctctcaggctcaggtgatcctcctgcctcagcctcctgagtagctgggactacaggtttgtgccactgcacctggctaattttttattttttataaagatggtatcttaccatgctgcccaggctggtctcaaactcctgggttcaagcgaccctcccaccttggcctctgaaagtgctgggattgcagatgggagccaccacatccagcctgaattgtctgtttcatataaatggaatcaaaccacatgtgatcttttgttactgctttcttttactttttgagtgtaattaatttttattgtatatatttgtattcatttatttttaaaaacattttattttgaaatatcaaacataaaagtagagagaatagtatgatgaacttgatgtgtccatcaacccctcttcaacagttatcaatttatggccacttttgttttatctgtatacctacctattttcccttttcccattggattattttgaagcaagtctcaaataacatattacatttttgtatttacctcacaaaataagaacatagagaaaccataccacaatcctttatcacacctaaggcaatttaaaatattttcttggctgggcgtggtagcacacacctgtaatccaagcactttgggaggctgaggtgggtggatcacttgagcccaggagtttgataccagcctgggtaacatgctgaaaccccttctctacaaaaaaatagaaaaatcagccgggcatggtggtgcacacctgtggtcccagctattcaggagcctgaggtgggaggatcacttgagcctgggaggttgaggctgcagtgagtggagattgtgccgctgcactttagcctggatgacagagtgagactgtgtctcaaaaaaaaaaaaaaaaaaacaccaaaaattaactttttttcattaataatcaaataaagaataaatatgcaaatttttaaatttgaaaatcaggattcagagttcatacattgtgccagattgatatatttcttttcttttttcttttttttagatagggtctggccgtgtcactcaggctggagtgcagtggcacgatcatgactcactgcagcagtgacctccaggctcaagtgattctcccatctcagcctcctgagtagctgggactacaggctcgtgccgccatgcctggctaattttttatatatttttttgtagagacggggtttccctgtgttgcccaggctggtcttgaactcctgaactcaagtgatatacccaccttgtcctcccaaagtgttgggattacaggtgtgaaccaccatgccctgccaatatgtttcttaaatctgttttaaaaatgccacctcctttttctttctacaatttccttgttgaataaattggtagtttgacctatagagtttgccatattctacattttactgatcgcataatcatgttgtcattttacatgttcccctgtttcctatatgtttataggaaaaatatagatctggatgtttgatcagatttaggtttagggttttttttttttgaaagtgtgtgtattatattgcctgatataggaggttcataatatctggttatcttcttctattttctgtgatcttaagattcatcagtgtttgtaggggttttcagcttgatccttgcattttgaaatttcccatcagcttttctttcacctaatggtcttagcagttattgcttagatatgctatttaattatgggttgcacaatggtgatattttaattctattacaacttcattttttttttttttgcagtaaaaaaatgtttaattgatgtgaggcaggccacatggtggtggttcttcttctttttttttttttctttttgagacagagttttgttctcgttgcccaggctggagtgtgtgatctcggctcgctgcaacctccacctcccgggttcaagcggttctcctgcctcagcctctccgagtagctgggattacaggcacccaccaccatgcctggctaatttgttgtatttttagtagagacagggtttcatcatgttggccaggctggccttaagctcctgacctcaggtgatccacccaccttggcctcccaaagtgctgggattacaggtgtgatcccacagtggtgcccggccagttcttcatttttaaaactatttttttttctcttgttccttgtgttttgggtgtcatacctatgaaatcattgcttagtccaaggtcaagagatttatccctatgttttcttttaagagtattatagttttagattttgtatttaggtctgtcaaccatttcgggttaacttttgtgtagtatgaggtaaggtacaacttcattcttttgcaggtaatatgtttgtgccagcaccatttgttaaagacagtgttctctctccactgaattgttgtgacatttttttgaaaataaattgaccacaaatgtgtaggcttatttctggattcccaattctattttattgatctatatgtctatgtttatgccaagaccacatagtcatgattactgtggctgtgtagtaaggttttaaatttagaagtgtgagttctttaacattgttctttttcaagatagttttgactatttttggtccctttaatttccatatgaatttcagatcaccatgtcaacttctgccagaaagacagctgggattttgttagacattgcagttaaatccgtagaacaatttgagggaatatttccatcttaacaacattaggtgttctgatacatgaacatggaatgtctttccatttatttaggtgttctttcatttctttcaccagtgttttgtagtttccagtatacaaagtttgcattaattagttaaattcatttctaagtattatttttcagaccattgtacgtgaaacagtgttctttatttttgcattgtttattgctagtgtatagaaatacaatttgtggcccggtgcagtggctcatgcctataattccagtactttgggaggctgaggcgggcagatcacttgaggtcaggagtttgagaccaacctggccaacatggagaaaccctgtcactattaaaaatataaaaattagctgggcacggtggcacatgcctataattccagctacctgggaggctgaagcacgagaatcacttgaacctgggaggcagagggtgcagcgagctgagattctgccactgcactccagcctgagtgacagagtgagactgtctcaaaaaaagaaaaagaaatacatttgtgtttgtattgattttatattctgtaaccttgatgaacttatttattacttctaatagtttttttaaaaactggattccattagattgttttgtatacaagatcatgtcatctgcatatacaaatagttttatttcttcctttccaatctgcatgtttttcacttcttttctttgcctgtgtcctggctcaaatctctagtacagtgttgactagaactggtgaaagcagacatccttgtctccttcttgatatcatggggaaagtattcggtctttcaccattaagtatgaggttagctgttgtgtttttcatagattttctttatgaggtggaggagatttccttctgttcctagtttgttgaatgtttttataaagaaagattttggactttgtcaattacttaatctacatctggtgaaatgatcatgtggtttttctcttatattctatttatgtggtatattacattaattttcatatatatataaatatatatatatatatatttttttttttcagacagggtctcactgttgcccaggctggagtgcagtgacacaatcagggctctcactgcagccctgacctcctgggctcaagtgacccttccgccttggctccccgaatagctgggactacaagcttgtgccaccatgcctggctaattttttttttactattagtagagatggggtttcaccatgttgcccaggccagtcttgaactcctgagctcaagggatcctcctgccttggcctcccagaatgttgggattacaggcgtgagccactgcgcccagaattttttgtatgttggagcaacattgcattattggcataaattccactttgtcattatgtagagtcctttttatatatttctggaatcagtttgctgtttgttgttgttgaaggtgttgttttaatatttataacagacttttgtatttagacttattttcttgtggttagtttaatttttatattagggtaatactggccttacagactgagttgggaagtttttgtatgttgtgtctttattttgcatttatctgaaaatattttctaatttgtcttgtgatttattgttttacccatttactgcttagtagcatgttgttcatcttccatatctttgtaaatttcttaacatttctgttattaatttctaattttattcctgtggccataaaacatacttcttatgatttcagttctttcaaatttattgatggttgtttaatgaagtagcatataatctatcctggataattttattagtgcacgtgagaagaatgtgtattctgctattgttgggtgaagtgttctatagatgtttgttaagtcttgttagcttttcatatttttgaagtcttatatttctgaagtattgattttctatctagatctaaccattattgaaagtgagttactggctgggcgtggtggctcacgcctgtaatcccagcactttgggaagagccgaggtgggcggataacttgagctcaggagttcaagaccagcctgggcaacacagtgagactctgtctctaaaaaaaataaataaataaaaaaaaagaaagtgaatcgttgaattcttcaatgtctattgttggattgtctatttttccattcaattttgtcattgtttattttatgtattatgtattttgggctctgatgctctgatgttatgtgcatacatgtttataattgttatatcttcttgatggattgactcgtatcattataaaatatctctcctgatttccattgtcttttttttttttttttggtttggagtgtattttgtcctattctaatatagccactccaggtttctgatctttttcatacttagcttttaacatatttgtgtctttgaatgtgagatgtgtctcctgtagactgcatatagttgtctctttaaaaaaaatttagctggttgtgggggctcatgcctgtaatcctagcaactcaggaagctaaggcaggaggatcatttggggtcaatattttgaggcctgcctgggcaacgtagaccttgtctttagaaaaaaaaccaaaaattaagttttgcacttaaacaaatttatattgtttaatgtatttctgttgaatgttactattgacataggtggatttacatctgccattgtggtttaaaaatttgtctcatgctttttcgttgctatattcctccttaactgctttattttgcattcggtgctgttattgttatacatattttatctataatatttaaaaatcgaacaatacgtttttataataattatcctagaggtttttgtaacttttaaagaagttgatgcgtaagaatgggaaaaaaattgaaaaagacaaaaatgaacatacagaaacaattttttaaaaaagttgaaggaagggaacaagtgtacctttatagcatttgttatagtaacatttttgggtgcaatttctggttcttttcatttgtttttgtgggttcatgttaccattttgtgtcattttcttacttcttttttttgggacagagtctcactctgtcacccaggctggagtgcagtggtgtgatcttgactcaccacaacctctccctcccgggttcaagcaattctcctgcatcagcctcccgagtagctggaattatagatgcgtaccaccatgcctagctaatgttttctttttgtatttttggtagagatggggtttcaccatgttggccaggctggtctcaaactcctgacctcaagtgatcctcccacctcggtctcccaaagtactgggattacaggcatgagccaccacgcctggcccataatagctttgctttaatccacttctgtgatcatattggaaaataaatttttttagccatgggccccgaaatacacacacacacacacacacacactctcacacacacacacacacgtacacacatagagtttaatataattgccttttacatcggttaagagaagaaagaagaagatacatatgtttatactgtctttttcctttttattttttgagactcggtcttgccctgttgcccaggctggagtatgatggtgtgatcttcgcttactgcaaccttgatctcccaggatcaagacaatcctcctacctcagcttcccaagtagctgggactacaggtgtgtaccaccacacccagctaattttttaaattaattaattaattaattttattattttatttttttgtagagatggggtctcagtctgttgcccaggttggtcttaaactcctgggctcaagcaatccttttgcctcggcctcccaaagtgttgggattacaggcgtgaacactgttcctggcctatactgtcttttataattataaaatttcctttacaagacatctcagtttaaaaaaattaattaattacttttttagcaagcatttctgtgaaagagagatctcagttttttatgtgaatttgaattactctctgtggtcaactgctttgagattcaagaagtccttcagtatttcttgtgagtccactagcagaggactctctcactagaatctgggtctcaacttatacaatgaaaatcagcatctttgagggtggagcctaggcaacggtagtttaaaaaattgtaccatgttattatttttatttttttgaggcggagtctactcttttgcccaagctaaagtgcagagacatgatctctgctcattgcagcctccacctctcgggttcaagtgattcttctgcctcagcctcccaagtagattggactacaggtgcacgccacccgtgcccagctaatttttatatttttagtagagatggggtttcaccatgtttgccaggctggtctctaactcctgacctcaagtgatccacctgccttggcctcccaaagtgctgattttacaggcgtgagccaccgtgcccagcaaattctgataataaaccaaggactataaccacagggttagatgatttccaaggtctcatgtagctctcacatcgtgtgacactgtggatagatttcgtagttcatgttagaccacaccttcgtagcatatcagtctgacagaggcctgtggttctcaaagtttgtccctagaaaaacagcatcagcatctcctggtaaaatgttaacattgcaaattctcaggcaccactctacgtggaatgaatcagcaatggacattcctgcaaaggacacagcagtatgtgtattaacaaactctatctctccatgtgattctattgcactgtgaagtttgagaaccactggcatagagaaagagaactgtgggctttggggtccgaggacttctcattagtcttggagaggtatgtataaatgaccagttattttgggcacctaacgtatcttcgttgagcacccccccgcttttttttttttaaggagaggaagaatatttgcattttcttaactcacatggttgttgtgaggctagagcgcttatgtcaaagcccctttgtaaactgcgaagcatgtaggcacacacaaggagtcattgtgagcaagggaagtacaattcattaagcatctcttctgggacaggaactattaattaattaattaattaattaattgagacagggtcttattctgtcgcccaagctggagtgcaatggtgcaatcttggctcactgcaacctctgcatcctgggctcagataatcctcctgcctcagcctcccaagtagctgggactacaggcatgcaccaccatgcctggctaatttttgtattttttgtagagatggggtttcaccatgttgcccaagctggtctcaaactcccggactcaagggatccttccaccttggcctcccaaagtgctgggattacaggtctgaggcactgcacccagccaggaatttcatatttattattttatttaattcataaccactctacatgtagtgaaataattatttagaaatccaatttagtttttgaattgtattggaatttatacattgaaattcaacatcaatccagctgcatcaaagtctaactatatggaaattcatcgatatcaaaatgtaagtacacaaagatcaaactgcatcaaaatccacaggagagctaggagaaaaattgtgtatattaaaatactaagagcattttgttgcattctcccacctcctcaccaacaaaagctcaaaatcttgtcctgtcatatcagtagctaaagcatgttaacacttagctcttacactaaactagttacttctttgacttaggggaagtcatacttccttactggattgtactttaatctttctattttaaaattagtggttttacagaaataaaatctttaaaatataattcttaccttagtctatttaaaacatgctgttacagctcagcatggtggctcatgcctgtaatccctgcaccttgggaggctcaggtgggcagatcacttgaggctgggagtttgagaccagcctggacaacatggcgaaaacccatctctactaaaaatacaaaaattaaatgggtgtggtagcgcatgcctgtagtcccagcttcttgggaggccgaggcatgagaatcgcttgatcccgggaggcagaggttgcagtgagccgagatgatgcactgcattccagcgtggggacagagagagactctggctcccccaacccaaaaaaaaaaaaaaaaattcatttgaaattagagaaaacttccctgccaacattggtccttaagagtgtgattaggagctctcagaagtcacgggttttattctgaaattaataacacttgcttcccaatagagaggtactcactgtgcatgagaatattttgatgttttgtcacagccatttcatatatggaggtgcgtgtgtgtgtgtgtgtgtgtgtctgtgtgtgtgtgtgtgcacgcacgcgcgctttattatttatttatttattttgagacggagtttcactcttgttgcccaggctggagtgcaatagtgcgatttcagctcacagcaacctccgcctcccgggttcaagtgattctcctgcctcagcctcctgagtagctgggattacaggcatgtgccaccatgcccagctaattctgtatttttagtagagacgggttttcgccatgttgtccaggctggtctcaaactcccggcctcaggtgatctgcctgctcggcctctcaaagtgctgggattacaggcgtgagccaccgtgcccggccgcatgtgtgtgtgctttaaaccactaatcttattggatgaatattattacattatatgacatttgcatgcattctattattattattattattattatttgtagagatgggggtctcactatgtatcccaggctggtctcaaactcctggcctaaggtgatcttcctgcctgtactaagattacaggcatgaaccaccacgcctggcctttttttaaaaaaataagtatttatttatttttgcatgcattttatggccaccgttatatatactatggcttaacaggggctagaatgtgaacttgaagttttagtgtttcggttcctttctctgtaaatttgaatgaggctagctagtgatggagtggtcagtttctgaagaatattgttatcttggcactaaagaaacaaattagctcccattttctattattcctgcatccaggcagcagaatctgtttgctttatttactgaagattcgtgtacaggcacagtagcagcctgtgttcctatggtttgaaggctttaagctctttgctgttttttttttttaatttccataaattatcatttagaggtaatagaaatggttgggaggttataaagattttccccctatcgttttttggcccagaaatctcctgctttgttctctcaaaggctgagtctttagcagaggctctgccaaaaagaactggagttttcccttgggaatcagaggaaaggctcagtattcagcaaatttgaaaaaggcaagcttttcagatgttaataagtctaaacaggacccaggaagctctgcagtctccaaggcagattaaatacccaagtggtataacctttccctcggctgtggccaggttcttaactattggtgataactttaagaacggatcacaaaggtggaattctcccaaaagtcatcactctgaacttggaatccaatacaagcttcaaaagtcacagcaagcaataagcactggcaacaccaggcgcctatttgggtgccagattttcacattttctttgggtttctcaccatgtctctaaccccagctgctagtgaatgcttaactgccagttgctgccacaaacgtcatgttggaaatgaaaaaaaaagttctctgccttggaaagagcacaggagacacagcaaaaagctagttattttcatcatcatcattattaatgcaaatttaaaagcacagagtcataaaatagacactgtgtacacatgtcctcaagataaacattctgtcatgtttgcttcagatcgttctcattcttttttcttatttatttatttatttatttatttatgagacagagtctcactgtgtcaccaggctggagtgcaatggtgcgatctcggctcaccacaacctctgcctctcaggttcaagtgattctcctgcctcagcctccccagtagctgggactacaggcatgcaccaccacaccaagctaatttttttgtagttttagtagagacagagtttcaccatgttggccagattggtctcgatctcttgacctcgtgatccacctgcctcagcctcccaaagtgctgggattacaggcaggagccactgcacccggcctctttttttttttttttttttttgatacagagtctagctctgtcacccaggctggaatgcagtggtgcgatcttggctcactgcaacctgtgtctggtggattcaagtgattcatgtgtttcagcttcccaggtagttgggattacaggtgcctgccaccatacccagctgattttgtttttttagtagagactgggttacaccgtattggccaggctggtctcgaacttctagcctcaagctatccacccacctcggcctcccaaagtgctgagattactggcttgagccaccgcacctggcccagatcgatctcattttctaagtaaaacatagagatagtgaaatctgcgtttacctctttccccagtccttattactttctctcaccaagggcagccacaatgctgaatttggtatttatccttcttggcaatgttttctgtttatatataatattataatcattatgtaatataattatatattaatacatatatctactaatatataattaatacaatacattataattataagatataactattatataattatgtactatattgtatataatcatatataaattatacaagtacaatataattttacataaattatataaacataactatataaattatatatataattttatgtacattatataagtatacttttacagaattatacatcttatgtatattatatatgagatatatattagatatatactagatgtatacatttgttgtttgtgtctatatatatggaatagaaaacatggccaagaagaatgcatgccaaatatatatttaaatatattaatatgtaatatatttaataaatctatatttaatagttatattaaatattttagttatataaatatataaatgcttatatttatagatactatgaatattatatagagatataaatatatatttgtgctggaaatgttttgtatatttaaattttttttacaagtggaatcatactatatgtacttcaacttgtttttttttccacttagcattgttctttttcgaattttagatattttcatgttgatatacagtatatagatataattcattcttcactttttttttaaagaggcagagtctcactatgttgcccaggttgggctcgaacgcctgggctcaaatgatcctcctgcctcagcctcccaagtagctggaactaaaggcacttgttgccatgctgggattcattaacttataatactcactaggacacttctgttatgaatattgttgggaaaattaaaaattaaatctcttgctaacttagaaaatccttttcacaaatgtggaaaagaaagaaaactggccgagcgctgtgctcatgcctgtaatcccagcactttgggaggctgaggcaggcagatcacctgaggtcaggaggtcgaggccaacctggccaacatggtgaaaccctgtctgtacaaaaatacaaaaattagctgggcatgatggtgggtgcctgtaatcctactactcgggaggctgaggcgggagaatcgcttgaacccaggaggtggaggttgctgtgagccgagatcttgctgttgcactccagcctgggcgacagagtgaaactctgtctcaaaaaaaggaagaaaaaaaaaaagaaaaagaagaaaggaaaagaaagaaaaccattgtgttactgaaagcattaaatcagacggggatgtgaatgacaggtaatacactaatgagactgtaagcatagaaagaaatgtcacacttttacataggcaagaatatatgatccatttacatatgtgttctcaatataaagcataacttgccctccagttagatttgacagcacttttattttacatagttcaggcaatattcaccttgtagttgaggtggccatatgttagctaattgcctttatccaaagaaaaaaatataacttctcttgtctatatgcccagcaggcatttaagatttaaagcaaggtacctaagctaaactccctgaggtaacaaggagatagaggtatatttatcttgatgttaatgtttcaaagagatggatccccaggtccttaagaaaaatattaggtggtcatgctggcaagaggcttatttagctctttagaacatttgcatagttatagaaaagatagaaggtggctttgtaataaccttttcttgaggaaatgctctaagaaaaggaagaatggaaaagccttttcctattcagcaactgggaacattcaatcctactatatactacatatttatttattcatttacttataaatgggcatgtaggctatttctaatatttcattatttcccataatatgccaatgaacatccttatctatgccttcctgggcagtgtgcaagagttactcagattatgagcattgttaatactacagatatttccaaattgtattcctgagtgcttatacacatttatacttacaccaacaaatataagactatccactttatccatttgttcacatcattaagatttgaggctgggtacagtggctcatacctgtaatccctgcactttgggaggctgaggtgggtggatcacttgaggtcaggagttcaaggccagcctggccaacatggcgaaactccgtctctactgaaaatacaaaaattagcggggcgtggtggtgggcgcctgtaatcccagtcacttgggaggctgaggcaggagaatcacttgaacccaggaggcggagagtgcagtgaactgagatcgcatcattgcactccagcctgggcaacaagagcgagactccatctcaaaaaataaaaagatttgaaatggccagaccttaaacattttgccaatctgacggatgtgaaatggtatctcattattccttaatttttgttttcctaactactaattgagtatgttacaatgtgtttattagccattcatattttcttttttgtgacgtgcttatttttgtagtatttgcccatttttcttttgggtttttggtcttcattattgatttataagagtcctttctatattttagaagttagtattttatttgttatatatgttacaaataatttcccctattcctagtattccccattgccaaagtcaactatactgttaatttttatcctcctttcattttatttcctgtattttttgtcatgcagaagtttttaactgttaaaatatatttattttcctttattacttgtactttttgcatcttatttaagaaattctttcctatgctgaagttagagatgttttcttgtgttcttttaaaagtttaaaagttttggctgggcgcggtggctcacgcctgcagtcccagcacttcgggaggccgaggtgggcggatcacgaggtcaggagatcgagaccatcttggctaacatggtgaaaccctgtctctactaaaaatacaaaaaattagccgggcgtggtggcaggcgcctgtagtcccagctactctggaggctgaggcaggagaatagcgtgaacccgggaggcggagcttgcagtgagccgagatcgcgccactgcactccagcctgggcgacagagcgggactccgtctcaaaaaaaaaaaaaagtttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgcccctgcagtccgcagtctggcctgggcgacagagcgagactccgtctcaaaaaaaaaaaaaaagtttaaaattttttttttttttttttttattttttttattttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttaagattagggagtggtgatgactctcaacgagcatgctgccctcaagcatctgttcaacaaagcacatcttgcaccgcccttaatccatctaaccctgagtggacacagcacatgtctcagagagcacagggttggggataaggtcacagatcaacaggatcccaaggcagaagaatttttcttagtacagaacaaaatgaaaagtctcccatgtctacttctatccacacagacccagcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagtgcccctcacctcccagatggggcggctggccgggcggggggctgacccccccaccgccctcccggacgggcggctggccaggcagaggggctcctcacttcccagtaggggcggccgggcagaggcgcccctcacctcctggatagggcggctggccgggcgggggctgttccccccacctccctcccggacggggcggctggccaggcagaggggtcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagaggggtcctcacttcccagtaggggcggccgggcagaggccccctcacctccggacggggcgcctggccaggcaggggctgatccccccaccgtccttcccggacggggtggctgccgggcggagacgctcctcacttcccagacggggtggttgccagacggagggctcctcacttctcagacgggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagacgggatggcggccgggcagagacgctcctcactttccacactgggcagccaggcagaggggctcctcatatcccagacgatgggtggccaagcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaacgaaaaccagtcaggcgtggcggcgcgcgcctgcaatcgcaggcactcagcaggctgaggcaggagaatcaggcagggaggttgcagtgagccgagatggcagcagtaccgtccagctttggctcggcatgagagggagatggacacgggagatggacacggagactggagatggatatggagacgggagatggatatggacactggacatggacacgggacatggacaaggatacgggaaaaggagaaggataccggacacggaaaaggacaccggacaaggatatggataatggaaaaggaaatggaaaacggaaaaggaaaaggaaaacggaaacggataaggaaaacgggaaaggaaaagggaaacggaaagggaaacggaaacgggagagggaaacgggagagggagagggagacgggagagggagagggagactgtggtctttatccaaaagtttaaaaattttgcttttcacatttagattataatccatgtagttttatttttgtgtatggtatgagatagacatctagatttgtatatagatggccaattaatccaacatattttatgtaataatattcacttttttcaatagtttgtgatgtttcctgtgtcatatcataattttttatatatatgtgcatctatatcagagatttccatttctggtccacctggctatttgtctatcccggcaactagactgtcttgattattgtagcttgtaagaagtctagcttattggagagtctgattaaattgttttccagtactttcttaactgtttttagattggcacttctctattgaatgactgagttcatcaagttccattaaaaaaaaacctacagattagaattgcatgactttatagattgattgagagaacagaccccatgagttttctcatgtatgaatatgggtaattgtttcaactatcaggggtcatttgtatctttcaatattgtttaatttttttaagagacagtgctttgctctgttgccccaacttgagtgaagtggcatgatcatagctcactgcagccttgacctcccaagctcaagtgatcctccgacctcagcctcccgcgtagctgggactgcaagtgcactccaccatgcccatcaaatttttttttttttttttacttttgtggatatggggtctccttatgttgcccaggctggtgtcaaactcctgggctcaagcaatcctcccaccttggcctcccaaagtgttgggattacaggcgtgagccactgcacccagtctgtctaaaatttttaatatgaaattcatgcacattttttcttaaattcattttaaggtaatttacatgtttagttgctatgatgaacccctttaaagtattttctaattattatttatttttatttttagatttttttttttttttgagaaaaggtatcactgtgtcgcccaggttggagtgcagtagcatgaacacatctgacactgcagccttgaactcccaggctcaagtgatcctcctcccacgtcagcctctggagtagctgggactacagcgcgcaccaccatacctggctatttttttttttttttaatttttgtagagacggagtcttaccggtttgcccaggctcatcttgaactcctgggctcaaatgatcctcttgcctgggtctcccaagttgctgggattaaaggcaagagccaccatgcccagcctaattgtttattttgaacatttggaattcaattgattttcatattgttgatcttgtatccagtaactttgatgaactgtcattatttctaatggtttgcctgtaggtttgtttgtattttcttactggtaatatcatgtcacctataaatatttattacttcatggctttctttctaacctttacactttatctaacttttccatgtccaaatgcattggctagcatggccatacagtttctattagtaagagctatagggacactctggacttcatctgtgctttaataggaatgcttctacaatttcaccattaaatttgatgtttgatgtaagcttttaatagatagtggtcatcaggttaatgaagttctttctagtctgaggatgcctttttttgtaatgatcctcatggatgagtactgcattttaatcaaatgctttttattgtcagtctgtatgtatgataaattacaataataggttttctaatgttcaattatccttaaagtcttaaaccatacgtaatcatgatgtatagtcaatttcttatatgttgcttattcaccaaaattctgtttaggatttttgcatttatcttcatgaatgagattggtctataatttttttcttgtacattttatcatttactcattcaacaagtatttattgagtccatactgtgttctgtgtactgttctagtgaatgttgatatagtagtgaataaaatagataaaaatctttgccctcatgaaacttatattctactatggggaagacagaccataaacaagacaatttattaaatatgtagtatattagatgttgacaaatgctaacgatacaaataagcagaaattaggatacatagtgtgtgtgtgtaggggggtatgcaatctcagaaaagaatttacagcaacagctctcttacaaggtgacattttaggaaagacatgtgagggaagagaaagtataatggctctgaagtaagcatgtttctggtaggttcaagaaagagaaaggaagccattgtagctagactgttttactatcagaccaataagtaaattgggtagctttccctctctttaaaaaatgtaattgtatcttacataattatactgtaatataaaaaccaggaaactgacaatggtacaatgtatatgtatcgttctatgcattttatcaagctgtgtagatttgcatgactttaaccttagttaatatacataacgatttcatcaacacaaatatcttccttcatgctacccctttatattcacgcccacacacttccttgccaccacatgtatcctctggcaactaagaacatgctctccatttctatatttttgtcattttgagagtattatataagtggaatcatacagtatgtgaccttttaagatttttttttcttttttctcagcataattttctggtgattcttgcaagttattgcatatgtcaataattgatttatttgtattggtattgagtggtgcaactttctgttttgttttattttgtttcgagacagggtctcactctttcaaccaggctggagtgcaatggtgcgatcttggctcactgcaacctccgtctcccggattcaagcgattcttctgactcagtctcccaagtagctgggattacacgcacacaccaccactcctggctaatttttatatgtttagtggagacggggtttcatcatgttgaccagactagtctcgaactcctggcctcaagtgatcgtcttgcctcaaccccccaaaatgctgggattacaagcatgagccaccgtgcccagctaagtggtgcaactattgaatagtattccatggcatggatgtatcatagcttgtttaactattcaccttttgagggacattttagtcatttccattttttggctattacagatgaagctgttatgaatattcctgtagaggattttgtgcagtcatatgttttgttttctctgggataaatgcctgggaacgtaattgctgggttgtatgataagtgttttaaaagaaactgagggccaggtacagtgacccatgtctgtaatcccagcactttgggagtctgaggtgggcagattgcatgaatccaggagtttgagaccagtctgggcaacatggcgaaaccccatctctacaaaaagtacaaaaaattagctgggtccagtgatgtacacatgtagtcccaactactgtggagtctgaggtgggaggataacctgagccaggtagttgaggctgcagtgagccatgatggcgccactgcactccagcctgggtgacagagtgagaccctgtctgaaaaataaaataaaataaaataaaaacaaactcttagaatgtaaaatatgtttggtcttttttttttctttattttgagacagagtcagggtggagtgcaatggtgcgatattgggtcactgcaacctccacctcccaggttcaagcgattcacctgcctcaacctcctgagtagctggaattataggcgcccaccaccatgcccagctaatttttatatttgtagtggagaaggggtttcaccatgttggccaggctagtctcaaactcctgacctcaggtgatccacctgccttggcctcccaaagtgctgggattacaggcatgagccaccgtgttatgcccagcctgttatgtcattcttatgcctttgagtcctcatagcttagctcccacttgtaagtgagaacatacgacatttgggttttccattcctgtcactcatactttgggtagaatggaagcctgcaaacctgtgtggcttcatgctgggagactttcatgtaatatgatggactggactaattattaatgattgaatgggattctagtaatgtgccagtatcttttgaattctgtatccttctgatgtaaggccagcagggttctaaggggtagagagtagggacttgtgatattgcaaaatatgtattcggtctttgagcaggtttcctgacatacaactcctaaaatcattcgaatcttgtaagtgatgtctttttgtatgctaataatggacccatgcctggcaccttctaggtagcgtcacgatagggggtggtcaccataaagactaaggcaggaatagagggttgggacttgagtcccactcccaacctccagggagggaagaggggctgaaggttaagttggtcaccaataatcaatggtttaatcaatcatggctacacaatgaagcttccataaaggcctaaagaactgggtttgtagagcttccagatagatgaacacatgaaggttcccagagggtggtatgcccaagtagggaagggaagccctgttcctctttccacatgccttgctctatgtatctcttcacctgtatcctttgtaatatcttttataataaatcagtaaacataaggggtttcctgagtttggtgagccgctctatcaaattaatagaacacaaagagggggtaatgggtaccccaacttgaatctggtcagtgagatgttccagagacctggacttgggtctggtgtctgaattggggtagtgttgtggtaccgagcccccagcctgtgggatctgatgctatctccaggtagatagtgtcataattgaattggatgatgcccagctggtgtccactgcaaaattgattgcttatttggggtatgggggaaaattcccaaccatttggtcacagaagtcatgcatgttgattgttgctgtgttgtgagaatatagaaaaatgggggggggttcattcatagaaactgtcaaagtgttttctagagaggtttcacaattttacatttgcaacaatgtaataagaaattcagtttttctgtatcctcaccagcatttggtattgtcactgttttttgttttagcctttctgatagctctgtggtaatatctcaatatctctttgtatttatatatatttttttgagacggaggcttactctgtcgcccaggctggagtgcagtggcgtgatcacagctcactgcaacctctgcctcatgggttcaagcgattctcctgcctcagcctcctgagtagctgggattacaggcgcccaacaccatgcctggctaattttgtatttttaatatagatggagttttgccatgttggccaggctggtctcgaactcctgacctcaagtgatccacccatctcagcctctcaaagtgctgggattacaggtgtgagccactgtgcccggcttctctttctattctttatgtttactgatcagctatttatgttgactattgtttcttatgcttatttgccatccacatatcctctgcagttaaatatttttttatatctgttgcccgttttctgtttggattgttatcaattttcaactttgagtattctttatatgtataaagaattttatatatgagtcctttgtgagatatgtggtttgtgaatactttctctcaatctacaacttgtcttttcatcctaacaggtcttttgtagagcaaaattgtaaaattttgttggagtttaggttgtagatttatttatttatttattttctttggagagcaagtctcattctggtctctcaggctgcagtgaaatggctagatcccggctcactgcaacctccacctcccaggctcgagcaatcctcccacctcagcctctcgagtagctgggactacaggtgagcgccaccacactcagccaatttttgcatttttcatagagatggggccttactgtgttgtccatgctggtcttgaactcctgtgctcaagtgatccacctgcctcggcctcccaaagtgctgggattacaggcatgagccaccatgcccagtcattttttttttcttttataggtcatgattttggtattatgtctaagaactcttcgtcaaggcctaggatctaaagattttcttcaaactttctcctaaaaattctgttgtttaatgtttaagtctgtgatgcattttgagataatttttgaataaggtatgaggtttaagttgaggttcatttttatgtctcatgttcagtggctccagggccatttattggaaaagtaatatttcctccattcaattgcttttgtacctttgataaaaatcacttgggtaataatttgtgtagatattccatttcaccctcaggagggcataaatgtggactgcacatggtgattttcttcctaagatgcagtatggaaaggaggaaagaaagagtaatttgagagtggagaaacctgacactgcgttatccaggtgatcaaggtcaacatcaatagtgataaatcatgttgatagtgtatacctgtggtatgatgtatgacagtggcactttatctcagtggtatttctccccaaaatttataatcccagtgtaatcatgataaaaacttaagacagatcttaattgagagacattctccaaaatacctgagcagtacttctcaaaaccggcaaggtcatcaagaacaaggaaagtctgagaaactaccagagctaaaaggagcctaaggagtcatgatgactaaacgtaatgtgggatcttggatgggatttggaaaagtaaaaagaccttaggtaaaaaccaaggaaatctgattaaagtatggactttaataatgtatcaatattcactagttgtgacacatgtaccatactattatacactgctaataacagaagaattgggtgtagtgtatatgggaactgtactctctttgaaattcttcaataaatctaaatcattctaaagtttatttaaaataatcagtggggctgggtactgtggctcatgcctttaatcccagcactttgattttttaaaaaggagctattttagttcctttatgtttccatatacattttagaattattttgtctgtctttgccccaaaaaaatcttgctgtggttttgataggaattgcctgaaacctgtatatcaatttggggagaattgacatttttattatgttgagtcttataatacataaacatggtaagcttctccatatatttagactttgatttcttttgtctgtgttttgttttcggtatacaattcttgaataggtttagttagaattacatgtacttgttttttgggggggttcattgtaaatggtattgtgttttttatttcagtttctacttgttaattgctagtatatacaaatacgattgatttttgtatgttgattttgtatggggcagctttgctgaactgatttattagttctaggaattttgtggcagattgcttggtgttgttttacagactatcagtcatctgaaatacagacgctttgaaatagagacacttttgatacgttgtaactttagttcaatgtatagttttttgtttgtttgtttttttacttgagatggggattcaaagtgttgggattacaggtgtgagccaccttgcctggcctcagtgtgttgttaattttccttgagatttcctctttgacctataggtttaggaatgtgttagtttccatgtgtttggaaattttcctgatttcttactgctactgatcttttcttttttcttttcttttcttttcttttctttctttctctttccctccctctctcccttcctcctcctcctccttcctccttctcttcttcttcttctttttcttttcttttctccttccctcactccctcctttcttttttctttctctctctttctttctttctctttctttctttctttctttctttctttctttctttttttctttctttctttctttctctctctctttccctccctctctccctccctctctcccttcctcctcctcctcctcttcttcttcttctctttttcttttcttttcccctcgctccttccttccttccttccttccttccttccttccttccttccttcctttctttctttctttctttctttctttctttctttctttcctctctttctttcttcttcttctttttctttttttttttgagacagattttcactctgttgcccaggctgcagagcattgtcaccatcagggttcactgcagcctcgacctcctgggctcaggcagtcctcccatctcagcctcctgagtagctgggattacaggcatgcattaccacgccaggctaatttcatgtattttttgtagagatggggctttgtaatgttgcccaggcctttctcgagctcctgggctcaagcaatccacatgcctcagcctccccaagcactgggattacaggcttgtgccaccgtgcccagcctgttactgatttctagtttgatttcattctgaccacagaatattccctgtggaattgaaaataaaaaaactttttttgaggttggttttatggctcagaatatggctgtggtaggcagaataatagcccttcaaaggtgtccacattctactcacttaaatttataaatgttatattgcatggcaaaagggaattaaggttgcaagtgtaatgaggtttgctgatggcctaattttgagatgtgagcatatcttggattagccaattgtgcccagtgttttcataacggtctttatacattgaagagggaggcaggaaagagagaaccagagtggtggaggtgtcataaggacttgatctgacattgctgatgtagaagatggagaaatctttggtcaggaaccaagtaatgtgcgtggctgggaaaggcaaagaaagagagtctcactaaaagcctccagaaggaacacagacctgctgacactgattgtagctcagtgaggcccattttgaggtttgacttcaagaactgtaagacaatacatttgtattgttttaaaccaccaagtttatggtaatttcttatggcagcgaatagaaaactaatataatggtctatatcagtaatatatcatggacgcttgaaaagaatgtctattctgctaattttggttggggtgttctataaattttgattagatcctgtagaccgatggtgttgcttagttgttctataaccttgctgtctagttttatacattgttgaaagaggactgttgaggtctcctattgtaattgtggatttgtctcttcttatggttctgtcagtctttgctttatgtgttttgaacatctgttgttttgtgcatacacatttaggaatgctatatcttcttggtggattggcacttttaacattatgtaatgcccctctgtatccctattaatttatttgctctgatgtctactttatctgatattaatataaccactcctgttttttttaatttttagttatttatttagagaccagattatgagactgtcattataataatattaagtcttctaatccatgaacacagatgtctttgcatatatttctgtctttaatttctttcattaatgctttgtagttttcattgtacaagtcttttgtctccttggttaaatttattcctatgtattttattctttgagacgctactgtaaatggaattatattcttaatttttctaattgttaattttttagtgtatagaaatgcaactgttttttttgtgttggttttgtgtcctgtaacttctaaattcatttattaggtctaataatattttttgtgaattttagggattttctgcatgttaagttcatgtcattggcaaatagagataattttacttcttcctttacaatttaagtttacattttattttctttacttgttaaattgctgtggctagaacttccaatactgtgttgaatagaagtggtaaagcttctagactttaataattgagtatgatattagctgtgtgtttttcatatatgacctttatcatgttgaggtagcaatcttctattcatagtttattgtttgttttaatatgaaatgtgttgaatttcatcaaatgaaatgtgtagaatgacttcgcataaatcgagatgagtatgtttctttcttactttctgtctttctctctctctctgtcccttcctccctccctacctccttctcccccctctttctttctttcttccctttcttccttttcttccctttcttttctgtcttctgactgggtctcactctgtcacctagatcaccaaggctggagtgcagtggtgtgatcatagctccctgcaggctcgaactccttggctcaattgatccttctgcttcagtctcccaagtagctgggaagatgcacgtgaccatgacaggcttccctttgtttttattaaacgatgtataatatcgactgattctctctctgtgtctctttctctctctgttttttttttttttttgagatggagtcttgctctgtcgcccaggctggagtgcagtgacacgatcttggctcactgcaacctccacctcctgggttcaagcggttctcctgcctcagcctcctgagtagctgggactatatgcatgtgccaccatgcccagctaatttttgtatttttagtagagacagggattcaccattttgcttaggctggtcttgaactcctgacttcaggtgatccgcctgccttggcctcccaaagtgctggggttacaagtgtgagccaccatacctggccaagatgttcgtttttttttgtagtgtttttctctagctttggtatctgaatattttagaagggtttgagaagtattggtgttattgttttttaaatttttggtagaattcaacagtgaaaccacctggtccagggcttttatttttatttttattttttttggttgggaggattttttttttgaaatggagtttcgctcttgttgcctaggctggagtgcaatagcacgatctcggctcactgcaacttccacctcctggtttccagcaattcttctgcctcagcctcccaagtagctgggattacaggcatgcgctaccacgcccggctaattttgtatttttagtagagatggggtttcaccttgttggtcaggctggtctcgaactcctgacctcaagtgatccacccgcctcagcctcccaaagtgctgggattgcaggcatgagccactgtgcctggcccggttgggaggattttgattactgattcaatctcctaatggcattcatttattcagtttttctgtttctttgttattcagtttttgtaggttgtgtgttacaaggaatttgtccttttgatctaggcaatccaattggttggcatgcaattgtttatagtattctcttataatcctattgattcatgtaaaattggtagtaatgtcctctcatttatttctttttaaaaaaatttaatttttttaatttttgtgggtacataataggtatatatacttatggggtacatgagatattttgatacaggcatacaatggttaataatcacatcagggtaaatgaggtattcaatcatgtcaagcatttatcatttatttgtactgtaaaccaattatactcttttagttattttaaaatatacaataaattgttgttgactatagttacactgttgtgctattcagtactagattttattcattctaactatatcgttgtacccattaaccattcttactctcttccctcactccccactacccttgtcagcttctggtaatcatccttcaactctccatcttcatgagttcaattgttttaatttttagctcccaccaataagtgagaacatgtgaaatttgtctttctgtgcctggcttatttcacttaacacaatctccagttccatccattgttgttggaaatgacaggatttcattcttttttatggttgaatggagtactattcagccataaaaaaagaatgattagatctcatttgtggtatttgtgaatgacgtggtatatgtaccactttttctttatccattcatctgttgatggacacttagagtgctataagaaacatgggagtgtagatatctattcggtatgctgatttcctttcttttgggtatatacctagcagtgggattgcaggatcatacggcagctcaatttttagtttattaaggaagctccaaactgttctacatagtggttgtactaatttacattcccaccaacagtgtacgagggttcccctttttccacatactcgccagcatttattattgcctgccttttggataaaagccttcctttcctttctttcttatttatttatttatttatttgagatagggttttgctttgtcatccagcccacaatgcagttgtaggatcatcacgcactgcaacatcgagctcctgggctcacgtaatactcctgccttagcctcccaagtagctgggactacaggcatgtaccaccacacccagctaatttttattttttggtggatatgagtctcactctgttgcccagattggtcttgagctccttgactcaagtaatcctcctgccttggcctctctaaatgttgggattataagcatgagccaccgtgctcggtccctaattttattcctgattttaataatttgtgtcatctctattttttcctattcagtctagctaaaagtttgtcaattttgttgatctctttaatcttttggcttcattgattttccttattgtttttctattgtctattttattgatctggggactattttttattttctttcttctactatcttatgtttagttttctctttttcaagtttcttaaggtgtaaagttagattactgattcaagatatttcttcatttttaatgtaagcatttacagctataaatctccctttcagcactgcttttactgcatgccatacgtcttgaaaattatgttgtgtttttggtttcatttatctcaagatacttgctattttatcttgtgatttcttctttgacttattggttgtttaagagtgagttattggccgggagcacaggttcacacctgtaatcccagcattttggaaggccgaggcatgtgggattgcttgagctcaagagtttcagaccagtctgggcaacatagtgggaacccgtctctacaaaaaaaaaaaaaaaaaaaaaaaattagccgagcctagtggtacatgccagtagtcccagctacttgggaggctgaggtgggaggattgcttgaggctgcagtgagctgagattgtgccagtatactccagctggggcaacagaatgagaccctgtctcaaaaaaaaaaaaaaaaatagaatataatttcatgtgtttgtgaattttcctgttttcttatattattaatttctagtttaatttcatttttatcagaaaaaatattttgcatgactttaagcttttaaaatgtattaacatttgttttgtggcctaacatgttgtctgtcctggagaaattttcatgtgcatttcaaaaaatgtgtgttttattgttgtgggatggagtatcctttatatatctgtttgttccagttggcttatattgttgttcaagtacacaaattccttactgatcttctgtctggttgtttcatccattattgtatctattatagtataactatctgtttcttccttcggttttatcagtgtttgcttcaccagctaggcacggtggctcacgcctgtaatcccaacactttgggaggccgaggtgggcgcatcacttgaggtcaggagctcgagaccagcttggtcaacatggtgaaaccccgtctctactaaaaatacaaaaatgagccaggtgcgatggcgggtgcttataatcccagttactcgggaggctgaggcaggagaatcgattaaacccaggaggcggaggttgcagtgagcccagattgcatcactgcactccagcctgggtgacagagcgagactccatctcaaaacaaacaaacaaacaaagacatacctttgcttcatgtattctggggatttcatgtttgttgcttgtatgtttgtaattgctgtgtattctacgtgaattgcccttttaaatatatattatccattttgtttgatattcccattttgttctttttctttcttttttgggagcggggacagggtcttgctctgttgcctagcctggagtgctgtggcactatcatagcttactgcaagccttgacctcccaggctgaagccatcctccagcctcaacttccctccaaccaccttagctggggactacaggcatgcaccaccattcctggtgattttaaataattttttttttgaaggggtagagacaacttctcacaatgttgcccaggctggtctcgaactcttggtttcaagcagtctgcttgccttggcctctcacagtgctggaattacaggcatgagccatggcacctggcctcccccatgccttttattcccttatttgggttttcctatcagtgcctcttttcctagccttatcttctattttttcttttatattttgcagctgtttttctccctgtgctgtgctctggatgatttcttcagatctgttttctagtttgctactagtatgttgatggttattttctcttagcaagtaaaaactaataatccattttttggcagtgttgttgttgagcaaatggctgtcattctgattcttgtttcttttgagataatctgtgactggtatatggattctaatttttactatttttttgaatatttaaattattcatatttaaaaattactttttggagtgtaatataatcctagatcttacagaagagaacccacttatttgccttgactgctgcctggctctcatattggtttcctagtgtggtttataattttcaactgtgaagttctgggtggcagttgtttctttgggattcccttatgtgccctgggttatagaggtgttcttatggggcattttttttttcctcttcttagagcttgcgtggtgctggttcaggattagttttaaaattaacttttagaaacctttgtgagcagtataaacttgaactctaattagcaaaagcttgtggttctggataactttattttaccacaatgggagactctctagtgtattcctacagtgtcatatgccagtagacctcatgaagggacctcattccaagctcccagctcctaagtaatgtccctttgcctgctgataaaattccaactaccacatatagtcaattcttgttattcatggtagttatgctctgtaaagtcaatgtaaacatttagttagtgaatactgaaccatttctcctagaggaaatacagggttaggtacctgtgagcctctccacgttttcagcagccatcaatacataaacttgttttacctggtttctgtttaaagaccccatattttatcatatatatagttgattcattaacattgaattcatggctaacagcactagaagctgtggctgaacgaagcttatctagcacctacttgttttctctgtaaggatgtctcagccttctttcctttaggaccaccagatagtacttcagcactatgctaaggggccatgttaaacagctaacccatcaacaagaagtagaaaaatgtgacaaatgtggcactaaatagaccaggaaaaggacaattgttttatagtatgagagctgaaacaagaaggcagtatcccccttttcaagctcagaatgtatatattggtgactcacatttttcatagctatttgcatgtccatgaatgagtgggcaaaatgtcgtaagtattgattttggtgttgcaagtacattttattgactaggcaaatttgcaaatatagaatccgtaaataatgagaactgagtatatctagttctaatctctctactgcctcagctgctgctctctgttatggctttgaatttgttcttcatttctagtacttgggagcttctttttcttgctttctcagtttgctatgtattttaaaaatacacacatgtttgttgcccttttacccagtatttttatgtatttggattaggaggaagatattttggttaaatcaatctgatttatagagtagctacttcatttactcattttaaaaaggaaaaacatatactcaagagtgttaaagagaagagaccttgaggattatcttgtttattggttcttaacatgggtttcttagggcatctggaactgtagagattgtacagaagtttatgttacatatatctttctgggaagaaagtattttttatattctcaaaggggtctataaccctttaaaaatgcaagaaccaggctgggcgcagtggctcacacttgtaatcccaacactttgggaggccaagacaggaagattgcttgagcacaggagtttgagatcggcctcctcaatatagtgtgaccctgtctctacaagaaaaaaataaaaaaataaatagccaggtgtcatggcgcacagctgtagtcccagccactcaggaggctgacgtgggaggatcacttgagcccaggaggttgaggctgcagtgagctgagatcatgccactgcactccagcctgggcatccgagctagaccctgtctcaaaaaacaaaaaaacaagtgcgagaaccactgtcctagtctagtttcacttcaaatttataggctaactgcgtatatcctcattagttcatatcagtctagttaatagcaacgttagccaaattttaaaataaaaataactacatttagaaagtgatttattttcttttcttttttcttttcttttcttttcttttttcttttcgtgagatggggtctcactctgtcacccaggctgcagtgcagtggcacagtctcagctcactgcaacctctgactcctgagctcaagtgatcctcccatcttagcctcctgagtagctagaaccacaggcacacaccaccacgcctgcctgattttttgtatttttggtagagacggggtttcaccatgttggccaggctggtctcgaactcctgagctcaagtgatctgcctgcctcagcctcccaaagtgctgggattacaggcgttagccactgccgcacccagccaatttattttttgtgaaagaacttcaccatgacatcttattttaatccccccacaagccaatgaggtatatgatattatgtttctttcacaactgtaggaactaaagggaagccacagtaactggtaagtagtagcatttttttgtttttgattaattgaggcccagggaggcaagttaacttgcccaaactcatgaaactgatttgttccagaggcaagactaaaactcctgtcttagtgatatttccactacctcattttgctttggaaaagcacataaccttaccaggtggtaatgtgatgagtcattgaaactaataaattcataagtataaagggatgcatgtgttaagagaacattttttatttcaaactgaaagtagtcaaaaccacaaagcctaggaatccctcgggcatttttattgtgtaatctgctttagaattagagttgcatccatgaagttttgagtcatattgaaacttagctacctaagtttcttcccagttaaaaactaggtgcaaatggagttatacacaatacaggtaaatatatatacctgtacttgtagataacgttttatacatgttttcctgttctatacatgttgcattgtagtttgtctcctctataagtggaaactaattaggacttgagcttcattatttccttttcttgatacaccctttttccactccctgggttgatcagtacctttggcactaatatctcagaacaattttctataggttatccttatgcagcttttatggcataatggattactggcacaattcacatggagtttcgtatatccattcgctataaattcctttttttttttttttgttgacatagggtctcgctctgtcacccaggctgaagtgcaatggcatgtgatctcacctcactgcaacctctgcctcccgggctcaagcaattctcctgcctcagcctcctgagtagctgggactacaggtgcacaccaccatgctcggctattattattattattattttttttttggtagagacagggtctcacaatgttgcctaggctgctcttgaactcctgagcttcaggcaatccgcatgcctcagcttcccaaagtgctgggattacaggcgtgagccaccacatctgacccactctataaattcctaatgtaatacagctatagtaatgaaactgtaagctgtgctaaatttttgcaacatttatttaatattcctgggaccactgaaatggtagtaaactgcttatatattaaagtggattttggggctgggtgcagtggctcatacctgtaatcccatcactttgggtggccaaagtgggaggatcacttgaagccaggacttcaagaccaacctgggaaacaaagcaagggtctgtctctacaaaaaattttagaaattagctgggtggagtggtgtgtgtttgtagtcttagctatgtgggaggctgaggtgggaggatcacttgagcccgggaggtcaaggctgcagtgagctgcaatcatgccactgcactccagcctgggtgacacaatgagaccctgtttcaaaaaaagaagatgaatttggggaaaaagtagatttaatttttcggacagcttccatctattaaattagacctttagaaattaaaaagttgatttactcttttaaagtcatacattcatttggctaacattgacgacctactttatactggacattattttagattttgagattatggataagaaaagcttttcttttctctgaagcagctcatgtattttccttctccttcattcttgctccccttctttgtatctcccaacttcccattccagttagttactgattcctccccaatctttcgataaagtttgttataatctaatgcctagaatctttttctaacatttgctccagtaacgagtagtagtcagctccagtaatgaagagctcattatctttacctggcttccccctaaaagcagagagagcttgatgcagaggcttgggagcagaggtagtttaagtggaagcaagagtgagggacaaaggaaatgatcaatgcagggagtggaaaagaagtgaaatgggaaaggaggaaaagccaatatttggatgcattattgagttggccaatgctcagacaactagtttaatcatgctgtagcctctgaagggccttatgaaatatgactgagaactatccagctggggactgaagagtggaagaatttattcagcagctccctcaccactgtatgttttaattggttctttcaaaattatttccattgttttattgatattttctctttggtgagacattgttctcagtctttccttagttcttaggcatggtgtcccgttgagcatggactattgtttcctgtgtcttagtctgtctcataattttttgttgaaaagtgaacatataaaatcatgtggcaactctggaaattagatttttcccttccccagggtggttgtttgttattgtatgcttatttattgactttttggactaattctataaagtgtgtattctttgttgttagaagccactgaagcctctggtaggtttgcttagtgggcagctaatgattgaacaatgatttaatttaaatactttgaaccaatagccttccagcttttgctgctggtcattgtgtgaattgggatatgctttcaacgacattcacctagtcagatgaccattatgccttatgtttctcttcctgcttgtgcagaacctcaaggctaagcaagaggtgagagattaggaacttcttaagtctttcatgggcctatgaatagcctggaacatgcacatattcttttttatgacccatgtctttctagattttacattgcaacttttcaaagcccccatgggcaggccattgtccattaaaaattattatgattattattttgagatggggtctctctctgttactcaggcttcagtgcagtggtatgatcactgctcgctacagtctcgacctcttgccacttcagcctcctgagtagctttgaccacaggcatacactacgtcacccggctattttttatttttattttttctagagatggggttctcactatgttactcaggctagtctcgaactcttgggctcaagccatcctccagcctcagcctcccaaagtgctgggattataggaatgagccaccaagcctggcgtgtcttgattttatttaattaattattattatttttttttaccaagtgttttggtcagcctcttgttaatttcagcttgtcacactgcttcaggtcaccataatcttaaactatttcagatgattgtttttgacaaattccccaatagcagtgttgttttcacagaatgaacttaaagtcagaacaaactaagacaaattttgagtatagagcttataggacatattaaaccggatggcaattttctgggggtagggccttgtgaaacttcaaccacattctgccttctctagtggctgctaagctgttgattttcacagctgttgtagctgtatgactgtgggttttcagtgttactgcagagatggagatggtgctttgattagcataccttaatataccaaaaaggtcactgttcttatagagattcagtctttttaaaattaaataaacagtattcagattgctaagccctttgttaatttaaagaatgctaagccctttgttaatttaaagaatattcgcaatacatttatctggcaaaagactcgtttccagaatacataaagaaatcttatagtttagtcataagacaactcaattataaaatgggcaagagatttgaacagacccttcttgaaaaaaagatacgcaaataataaatatatgacatttatatcattaatcaccagaaaaatgcaaattaaaactagtgagatactattacacacccattagaatgactaaaatgaaaataaataaataaataaccaggtgttggcaagtatgtggatcatctgaaattatcctacagaatgcaaaatggtataatcatgtttgaaaaaaaatggtcatttattttataaaagattgataaacatttttatttgatacatatttgtatgtatttatgggatacagtgtgatatttcaatatgtgtatataatgtgtaatgatcaaatcagagtaattagcatgacctaaaatatttatcatttctttgtctgggcaacattcaaaatcctgttttctaactatttgaatgtatacaataaaatattgttaactatagtcacactgcattgcaatagaaagtggaactttttcttctgtctagccataattttgtatacattaaccaactcttctttgtttctttgagacaggcctaaccaactcctctttatcccctgctcctccctacccttccaagcctctagtaaccactactctattctctacttctatgagatcaacttttttagctctcacatacgagtaagagcatgtggtatttatctttcttgtccctggcttattttagttaacataatgtcttcaaggctcatccgtgttgccatgaatgccaggattcatgctttttaattgctgaataatatttcactgtgtatatatattacattttctttctttcttttttttttttgagatgaaatttcacttttgttgttcaggctggagtgcaatggcgtgatctcggctctctgcaacctccgcctcctgggttcaagcgatcctcctgcctcagcctctcaagtagctgggattacaggcatgcaccaccacacctggctaattttgtatttttttagtagagatggagttttaccatgttggtcaggctggtctcaaactcctgaccttaagtgatccacccgtcttggcctcccaaagtgctgggattacaggcgtgagccactgtgcctggcccattttctttactcatttatatattgatgaacacttaggtcgattccatattttggcattgtgaataggtgctgcaataaaaatgatgcagatatctctttgatatactgcttttggggtcttttgtgattccagataaattgtagcatttgttttgatatttctgtgaagaatgccctttgcattttgttagggattgcactgaagtatagattgttttgggtagtgtgttcattttaacaatattaacttctaaaattattgaacatcggatgtcttttccttatttttgtgcatcctattcactttccttcttcagtgttttatagttttccatgtgtagatcttttacttccttggtcaaatttattcctaggtattttatttttttgtagctattgcaaatgtgattgctttcttttttaaaatttttatatttttaagatacagggtctcactctcacctagacaggagtgcaatagcatgatcacagctcagtgtagccttgaactcctgggctcaatcagtcctctcgcctcagcctctcaagtagctaggactacaggcttgcaccaccacacatagctaatttaaagaaaatttttttgtgtggagacagggtttcactatattgcccaggctgatctcaaactcctgacctcaagcaatcctccttccttggcctcccaaagctctgagattaaaggcatgagccactgcaacccgtcgtgattgctttttaaatttcttttttttcttttttctttttttttttgagatagagtctctttgtgttgcccaggctggagtgcagtggcaggatctcagctcactgaaatctctgcctctcgggttcaagtggttctcctgcttcagcctcccaagtagctgggactacaggtgcatgccaccatgcctggctaatttttgtatttttagtagagatggggtttcaccatgttggccagtctggtttcgaactcctgacctcaagtaatctgcccgcgttggcctcccaaagtgcttaattataggcatgagctactgcgcctggctcttgatttatttttagctaaatgtggcactcgggttatgtatacttaccaatttaccatgtaacccatgcattggagaaatgaaaacatacgccctgaagaggcttgtgcatgaattttctttgaaactttattcacaatggtgaaaaactgaaacaaacactgatgtccatgaagaaatgataaataaacacattgtggtatatttacataatggagtgttacttagcaacaaaaacaaaaattactgatacaagcgataacgtggatgaattttaaaacattgtgcagacctaaatgagtccgatacaaaggagtctattttatatgattctattttcatgaaactctcgaaaagtattgtgatgaaaaacaggtgtctacactaattaatcaatcttgttcatattctgtctcattcccttaaagttcaaagtgcctaaaaagcactatccaactacattctataatgtgtaagggaaaggtgaagtaaagacattgtggaagacacatacataaataaggtgatggagagaggactctgaaagctggactgaaaaatattgacatagtggcagaatggacggggatggggaagataaaatgatgagttcacattgtttggagtgatgtagtgaatttaaaatgatgaagaattaaatgtgtcacacacgacaagcatttctaggttatctatggattctttgtagtctagaagtcatccacttcacttgtttatctaaaatatatgagtcttttccaggacttttctcagcacaagggacaaatgtatgggaacttggaccttgtttcaagaagagctgtgaatttatgcttgttcttttttttttttttttttttttgagatggagtctcgctctggcacccaggctggagttcagtggcatgatctcggctcgctgcaacctccacctcccaggttcaagtgattctcctgtctcaaccccccaagtagctgggactacagaagcccaccaccacagctggctaatttttgtatttttagtaaagatgggatttcaccaagttggccaagctggtctcgaactcctgacctcaggtgatctgcccgcctcagtgtcccaaagtactgggattacaggcgtgagccaccacacccggctgcttgttcatatttttgaatggaatttgtgtgcattgtttcattttttgttcatttgattctaaggtgaggacagtatttcctacttttatgtagttgggagcagtaaatggaaatgtttgtggaaagctcctcataaaatttcaaggccttttgtagatatagtgttttaaaggcccagagtctggagaaaagaagagataggtacaaataatgaaaagggagactagatgcaacttcttccttattccatgcctttattttcaaaatactataaatgttgaatattatagtatttgtggtttctgaaattttgagataattttaagaagaggaataattaataactgttccttccttggctcaaataatatttaggaaatactagtaggtgtggaagagcaacacaataaatgtttttatttaatttccctgagcataacagagagcagatggggaattctgggcctgcccttttttactgttagccaaggagagcagaaaaaataaattgttttccagacatggagccagttttgtgttctcgttgctgatgtactgtgaaaggatttgaagggtgtgcatgcacttgtcacattcatgtggcttagatttgtagtggaaaatgttattctagattgtcaaaattgtgagaagccatgctaacctggtctgtgtaaaaatgtcattattattgttattattactattttcagtgattcgttcaaagagttaagacttaaaattctgataataagtatttctgaaaatgagacaaagacaaaatgctaataaaatttttggcttataatttgtttcagccaaatgcttgaacttgttttattgtgtttttgcttaacgatgtcagcttttcattaaaaggactcagtgtggttgcttgccttgtctccattttccttggtctgagagcaaatactcaggctcagtaagtccatgcatatgataggtttgaaaatgcaggatggaggaggatgatgaaactagggagagaaagaagaaatcggaaaagagagccaaaaataaccaacaagcttaagctttcctagaacatggtctaacaggttagctttgttggtaagatcagtgtgcctcaaagttaaggagtatatgaatgccctggggcttggataaaaatgtaatttctgatttgttaagtccagggtagggcttggcaatgtgcatttccttccacctcccaggcgatgatgatgctgctggccttagaaccactcttggagtgcaacaagggtcaaaagttgggttggacctcttggtgggggcatatttaaaaaatctcaataaagataacttctcaaaagtatagctaaacatgatttaattttataccaacttatacactaaaatatattctaaaattcaaaatcattgaccaaaaataaaagcatttgtttggccatgtcaccctgattgttttcattcgttgctttcttaggtcaggtctcttgataaatactctgtgaacaagttaaggagtcttcgtcttccagatagcatcctaacccaggctgtcatctggttaacatgtaaaatgtccaggtggtacctgtatcatcatggatagggctctggagaagcagacagaccacctggcttctatttccagctttgccaccaagctctgggactttgaactccacacgtataaaatggaaagcatctagtgtattgcccataataggggtttaggaaatgtgtaaggagaccctcttaagagtatatctaagtagtttcatgtcttccatgctttgagtggaacaggtcagagaggagaggtgttgaggataaaaacatgtcccgtaacttttaaggactttactgagatgccccatcctttcttcttgtgattttagttgttcaaactttcttctactgcatatctaatcttttgttttatttcattaaatgctagttgcaacctgctcagagcacttacctttggttttcttttatctgctcttatagagatgaggaaatagatcaaagcatagcattgttgaacatttctcttgttacccttcctttgcagattattcttctgctgttcagaaattttcccagacgctgcagtcatttcagtttgatttcattggagacactctgactgatgatgaaattaacatcggtaagtcttcagctacatgtggtcatatacctgttgaggcagccctgagaccatgtagtctttttgatttgtggatacagagcacttggacatcttcatccactgtggtccaatgccaaggccctgggaggttgattaggaaggatcaggaaactttccctgccagtcccatttcctcctcacacgacagcaatcaaaagatacccttaaacttctactgagatttttgactcagacagtctgcaagcgaccttttctttaaagcatagttattttcctaaaggatatattaaaagggggacttttttggtttatttcccaaaatggttggagttagattcttctaaggaatcaaatttccctagaaagtgttaaattagcatttgtgtgtctacaacttatcaggaacaggttgcttagcatctctcttgggaattggatttaacaactcactctattagttgtataatcttggagaagatatttctgtctctgagtctcatcttgtcctctgttaaaatggggttaatatctatcaaagatgttaaaaagaggaggttgaatagtagaagtcaaaagaagtttgcgtttgtattatttgttatgaaggtaaagaggagaggttaacaaacccctgggcctattccagctcaccacctgcttttgtaaataaagttttattggaacatacccatactcatttatttaagcgttttctatgggtatttttgtggcacaagaatagcactgagtagttagtgaccaccactggatggtcctcaaagcctaaaatcgttatcttctggccatttaagaaaaagtttgctgattcctgagttaaagggttagtgtagagcatttgctagatgagaacactgaaccaaagagctattatgaatgatctattgttactggaacaagttagtaacacagttatatttattagccctggaactaaaatgtgaaaatgtattattattaataaatgcctattatagtcaattttaataatatataaaagtataagttacttatgataggaagatattcctgcacagaaatagtatcttggacatacttttatattatcctttaagtctttttctctacatatatctgttttctttgtatgcaatgtagttcatattaaatatataatattatctttctaaccaaatattttattataagcattttcccatgtaatttaagatttttcacaagttttatgggtggtttgtatggccttgttttgttcactactgttttcccagcacataaaggagtgcctggcatacagtagatgttcaatgaaatgttggtaaatgaatgagtaatggatacattcaaatttcattattatgagagctatacttcatttaatatttagctattcttggaaatatagcttatttccatttttcactattataagtaatatttcaatgaacattttttagatttagattggtgaccattttggttaaatgtgactgtgtaactagtgagtcagatatttgtatttgtattattttcttattcactccattttattttacttcagtaaatctatccaggtccaagtgcatgactatttaaaagttaacattatgggctctggaatcaagtaacccaagtttgaactctacctctacatcttaatagctctgtaaccttggcaagtaacttcacctctctaagtgttaaattttcttatcttgtaaaatggggatgagataatgccaagtgtgcatagtgtctaaatgaatgttaggtatttcaacattattattaatataagatatttttgtacttctttttaaaaataactgctacttgcctatcagttggaagattgggagatacatggtacatgaaattatataaatggctcctttttctggtataagggtctgattttgaacaggtgcctattgataccaaagccaccaacagatctgagacttttctcatgtcttcctttatgttgaactttgagccttaattctcttaatcccatgaacctcactgcaaatgtcaatgagtgctatgcaggaaaaagggtgtgtgagcctgggcaaaatgacttataaacaaaagaaaaatgactccttggtgatgccaggttcctgtgggggtctgtggggctccatcagagctgctgattatgacatctttgctgcttttttaaaaaaagaaagaaagacagggtcttgctctgtttacccagactggtcttgaactcctgggctcaagctatcctcccaccaccttggtctcccaaagctctgtgattacaggcatcagctaccacacccagtcttttgcttcttttttttttttttttttttttaagatggagtcttgctctgttccccaggctggagatcagtgggctcactgcaacctctgcctcccgggttcaagtgattctcctgcctgagcctcccgagtagctgggattacaggcacccgccatgatgcctggctaatttttgtatttttaatagatacacggtttcaccacgttggccaggctggtctcgaacacctgacctcaagtgatccaacccatcttggcctcccaaagtgttgagattacaggcatgagccatagtgcccggcctttttgcttcttaatgtatgatttataataactctttaactcagtgatcatttgcctgccaatttcagaagctcctacttatcatttgaacactgcttttaaggatgctgacttaatgaactgactttcattattgaggaccaaagagaggttttgaaaattcattggcctgtcatggtcattgtccttgttgaatctcattttgaaagctgggaattgtggtggtagtgagaggaagagccagtactccaacagctgaggctgaggctctctggaggcttcgagaaaaaaatactggggaccctactgggaggctattgttgggaaagagcagttgctttggaagctgagaacgcagagtgtgccatgccctcctattgccaatactgctggccctgagtcaatacatcttgtttcactggaaaaaaaaattgcttaaagcacactttggatggaattgtgatacccttttggatttcacattatatgtgcagagggccttctcattaaaaatttttcattattggctccaaaaggtcactcagtagcattgtaggtactcgttatttagcagaaatgacagtgcttcctagagctcatggagaaagcctgaggattctgaagagttcctccccctgacgatcagctctaggacttaccctgaatagtttatgtctaacagggacaagtgggaggccatgtgtcattgatctgaccgtgacttttttcactgctttagagttagacatctatgccttcttggcattgccttgtctttacctctatgtctctgtaaccaaaggaaatcccaggtgtctaagaagtcttgtgtctgcttagatttgagttttatatgttagctatgggatcttggtaacattaattgagcttgttgagcatctgttttccacatcagtatagtgggggagtataatccacctcacaaggtcatgaggagcaaatcagataatacttatatcagagagtgtctgtaaatcatttagctcagtgtctggcatatagttggtgctcaataattcattgttattgattctactaggaacactatagaaggtaatttgtggaaaacagtgttggtttgaaattatatttcccaaattaaccaaaggaaaatataggattgtaaaatgtccatgttggcagggaccttaaatagtatttagttcattatttctcgtataacttcatatccgagtcacctgaggatctcgtttatcctgtcacaggacctaccttatacctaaagaatcagaatttctatagcggagcccagggccttgatttttacatagtctttataacatcagcgagcattttgtaaccccaggacagatctcaagcttttccaaactgtgctccttggatcctcagtgtctcccgtctttcatgatcaaatgaaacagcggtttatattgggctttcatgtaagaatttgcttgaaaaatgggatttgtagattaaacgagagaaacagacacttttagagtgctcccaaatagcagatgtcattgtaagcactttatatagactaatgagagaaagagagacagaatagtagcaagtttatccctcaattcaacagatggagaaactgagatccagaggtagggatgtgattgtggaaggtaccacacagctacatagtaccagatttactattagagcctgaatctcctaaggcccaattgattcattcaataacattttattgagcatctgctataaagcttgtcctcatggacttcccaatcatacaagttttggcataggcaaatgacttgcaatgtcaccatagcaccatgagctagaaagaggcctgtttgccacataggcttaagagaatatgcttactttttttttttttttttttttttttttttgtgatagagtctcactcttgtcacccaggctggagtgcagtggcgtgatctcgactcactgcaacctccgcctcccgggttcaagagattctcctgcctcggcctcccgagtagctgggattacaggcatgcgtaaatacatgcccggctattttttgtagttttagtagagactgggtttcaccatgttggcccggctggtcttgaactcctgacctcaggtaatccgcctaccctggcctcccaaagtgctgggattacaggcgtgaaccactgcacccggccaggttactcttttctcaggatcccttatatgtatttttgttcattagtaaataggtagcgtgtccactaaatgacataaacaagggattcagagacatagaacacatcttcctgccttcaaggagctcatagtctattaaaggaggtggataactaaataggcaatggtaacacaatgtgataaggactatggtagaggtaagcacatggtagcccctaattcagactggtgtgtatatgtattgggggacgggatgatgcggagaataaacatggaagccttctcagagaagtgatatctgagtcagttccagggttaaggtgaaacaaggcaggtggctagggctcagatttaaggaggcacttactctcagggttgtgcaagtacaggctggcacttgagagtgaatatacctccttaaagtttacagcctgggtacctgggaattatttggtgaggatcttcagagggcctcgtattttaacttcaaatttcaatcttgtcatcagcagagcatggcatccattaggtgaaccctgatagcatagttcttttattctgtgcatctaccttgctacatcttttccagaaaatgtcacccatggggttttagtgggttgtttgtttatgcctgggggaataaaagtcatgttctaaatctcagactgtaaatcacatttccaccccagttatgctaacatatttaaagaaacacctttgtggaccaagaagattgatttaaggtcagacttctagatggaaagttccatcagccacccattactggtttctgagacatgagggtttaacattgtcagtcccctgatcctgatttttgtttaatgtgaatattattcattgctaaacaactcacagcagatcataaacctcttggttgagataaagaagggactaagaaatagtctcttgagggcttttgttggtatttttttctacaaaaccagttgaagtatcttttgagaagtggtggcaaatgtcagttgttttagagtcctggaggtcaggcatcttaaaagaggaatggctaaaatgaaaaaagaagcactaatgtaaaagattgtatttaagtaaagagccaggagttgaattctgaaggttcagtgattttcatgagattggtggggggaaaatcttttggttatacatcttgaagctcttaagctcatatgtcagttggtgacattgttcacaatattgattatctttcatataggggcatgcatgaaccaaatattttgccagactttcttagcacaggcaatagcttttctggggaaagttctagcccaatgcaccttctgctgtggtgataagcccttagaggtttatatcaagttattgggcttgagtgcatagggcttcttctcagatcctgaggaaaagagaaaatacaaggtaatcagaagtctctattgggatctgggccgtcaggttttagttctccatgactcgaagtcatatgagaaggtgataattgggctgggtacggtgcctcatgcctgtaatctcagcactttggaaggcaaatgtgagtgactcacttgagcctaggagctgattctaaatgctttcagggaagcatcagattaaaacataaaaacctatgtgtagatgagaaaggacttaaaatggcagtggccaacttattactgatcattttcaaaagtggaagacttgatgaaattttattaccagaagaataatgcaactgaaaaatacatgggatttatgtggcatataaaacaaaagaaatatcaatccataaaaagattttacaaaaaatctataatcataataacactattttcaaggaagagtgaatattatatttataaaaattggtaaacaacctttatgaagaaaaaagtcttcagacataacataataattctgacataatataccatgaacatagcaagcttatagttagaatataccaagaatatatcaataatatcaagtaaagctgggctcagcgatgcatacctgtaatcccaggtactcaggaggctgaggtgggaggattgattgaacaacccccagccacccaaaagaatatcaagtaaagagattgagaaatcttaataaaacatactgtggaaagcaagaacattgatcgttctctaagaacttcctgtatagcattcaatttctgaaatatgtacattggtaacgtttagcccatttaagctagggaagtctgaacatctcttttgatttcatggtgcttcctgtgcaactcagacgataaaacaaaaagcaccaaaactatgcactggacaattaaggaagttattgccatagggagaacctttattaatgaggaacatctcaaagaaatggaagaaaattggggtattgtagaggcaggtaaacaagggagtcacctgcaagtcttatgggaggcatgaagaagaatggagattgatgctatatatgaggtgcaaagtctatatatagactttgcagtctaaccatttttcagaacacagaaggatgtgggatgtcttaacactggctgctttcttggagccctggtctcagttccacactcagtggtccgggattcacaaagcagggcacaacccagtgtcctttcaaagctcccaggccctctgaggttccactggggaatttgagtgaagaagatggcactcatgcagagtgaggagactgctgaacatgagccccctattctcataggctttttgtacctttttgcccatttcccttctgactgatctggagactgactgctggttaagtgccagccagggtcaagtaagtggtacaaaatgatcccaagacgttcctatttgttgagagatctagcaaagtgaatgtcattttctcaggagcatcatttggcaggcccaggcttcaggcctgtctgccatttactctttctccctcattaaggtctcttggactccagtaatctttcactctgagctctcttctctatcctgttcctgccaccatattgtatccatagcaatgacccttatatcttggctcacttttcttcatggggatatggtaggatttagaaacatggtcttggatttggctggacctgagttcagactctgacctgtttatttactgactacatgatcttaggcagttttcattaaaaaaagtaataattgagtttattggtatctttgcattataatataaacatgctttattataaaaatatggaaatgaacaaaaagattattattagcttccgtatactgagtacctactgtgtgcctactgctttgtgtacactatctaattctcagagcaattttaaggaggtgaatgaggctaatggaggttaagaaacttgcccaggatcacatagctaataagtagcttaagtgggattttttttttttttaatcagggtttggctctgtcacctaggctggagtgcagtggcaggactgtggctcactgcagccttgacctcccaggctcatttgattttcccatctcagcctcctgagcagccagaaagcacacctcacctggctaatttttgtcgcttttttttccctttctttcttttttttttgagatggagtcttgctctgtcacccaggctggagtgcagaggcacgatctcagttcactgcaacctctacctcccaggttcaagcaattctcctgcctcagcctcctgggtaggtgggattacaggtgctcaccaccacccctggctaatttttgtatttttggtagagatggggtttcaccatgttggccaggcttgtctcaaactcctgatctcaagtgatccacctgcctcggcctcccaaagtgttgggattgcaggtgtgagccacagcacctggccctaatttttgtagcttttttcgtagagttgaatttcatcatgttgcccagactggtcgtgaactcctgagctcaagcgatctgcctacctcggctttccaaagtgaagggattataggcatgagccaccatgcccagctttaagtaggtctttaaatcatttcatttttgactttaaaatttatacatatatgcactccataaccgtgttaatgtcatagtaaataatcaataaatagttaagcctgagagctagatttaattaaaaaaaaaagaatcaattattttgatgtatttttttcttggcttttttgggggtcgaaacaattttctgcatatagctgtacttgtgtacaattgttgcatacagatttttatattctgtttttaaatagtgtgacactctagctattttgtcatgtacagaaaattttgtgtaatttcctttttaatagcttcaataatagtccattaagtggacatacttaataatttcccaatcattggacattttatgtgttttcaattattcatcatcagcaataatgttgaatgcctacctttggatataaaggtttatccctctgtattcagaattagttctttttgtttgtttgtttgttttttgtagagatggggggtctcacttttgtagagatggctcactgttgccatcaggcatttgagcaatcctcctgccttggcctcccaaagtgttgagattacaggtattttccaccatgaccatgccatgattaggttttaggtatggtttcccagatacgaatttacaatgtaaaagggtatagataattttaagctgtttgatccacatttgtcaatttttacaattgtttggaagacagtgcataacactgtaatttatatgaccttgctaaattaaacctcagttttctcatcactgaaattgtaatgatgaataataaaacacttgagaaacatctaccatattgcttttcccatctcacttttccgaattttttgtaatttctttgaaattttccaaggataatgttctcttgctgtggtctttttttaaaaagaaaattcttggattggtaaacattattgaggaattttgcagtaagttttataagccctgctttgtggtggtgttgcggcaggggatgttgctattattgatgatggtgttgttgtttgttatggttatgcagggctgttttcttccatttcttagccaattttcttagtcctcagtcctagtatctgaagagagggcaaaaggactctaatgactttggctccttaatgactattctctcccacactctgtaatggacagtctgatctcctcactaaagcttttattgccttcccattaattctacagagccgtctgcagggttagtttttagaagatgctgtaattaattatccatgatatttggttaaaaatagatccgtaagaggctttataggacctcaagattctgagtcagaaataacccttgtccaaaccttccgcttttgcctttttcttttgtcttttttttctttttctttttctttttgagatgaagtttcactcttgtcccccaggctggagtgcagtggcacgatcttggctcactgcaacctctgcctcctgggttcaagcaattctcctgcctcagccttccgagtagctgggattacaggtgtctgcttccacgctcggctaatttttgtatttttagtagagacgggggtctcacgatgttggccaggctggtcttgaacgtctgacctcaggtgatccatcctccttggcctcccaaagtgctgggattacaggtgtgagccactgtgcctggttctgcttttgcccttttcttgatttgctatagatatgaccaagggagagtgaatatgaggatatttggagaagaaaacaccatttgtggggccagttggagggacagtgaaaacaatgtgacatagtgctttcactatgactggggactgtagatagaacattgaaatggggtcctcttttgactgttcagctagctgtgtgaccttgaacaagtcagttccaatctctgggcctcagttttctcaggaataaaatgacatagttggactaagatagatgatctgtaaaagtcttaacctttttagaaagcaagtgattacaatcttagaatcaagaggctatcttgactttgctacatgcttcttgccctgtgccacatacttctctaggcatttgcagtcttccgatcaagcaataaatgtactcatagggctttttcaggccacatattcagcaatgaggtttttcttgactcagcaacttaattttaaagtgatttaacaattactgaagctgtatgttaattgaaagtaaggatcaagaagctctgaccaggttaccacggtgggaatagttgaaaaatgacctccaaaaattcgatctttcataaaagcagcaaaaacactggcagaaatttccaaaatcaacttttttaaaactccaaaaacgaaccaaaattttgcaacaaaacagtgcatgtttattaaataaaaatggctgaatagttgagaaaacactgagctctatgacattttaatttgccatgttcctattcctttctgcagttccatagtagctttgaaaactaacgtctgtataatcatgcaatgtgtgcaaaccaccattctagcagccatgggtgagggtagaatgggtgtgaagttactcaaaatttgagaaatatcactcacagggcttatgttatttgagttgactcagagtttactctttaaatggttgttgttgttgttttactagcgcattttctttcttttgtgcattttttttttttttttgagacagaactcctgacctcaagcaatcctcctgccttggcctcacaagcaatcctcctgccttggcctctgagattaaaggcatgagtcactgcaacccacttgtgattgttttttttttttttttaatttcttttcttttccttccttccttcttcctttctttcttcttttccccttcccttcccttctcttctcttttcttttctcccttcccttcccttccctccttccttctttcctttcttcccttccccttctcctccctccctcccttttctttctttctttctttctttctttctttccttctttcttccttccttccttcctttctctctctctttcttttttttcttcctttctttttctttctccttccttccttccttcctttcttcctttcttaatttcttttccttccttcctgccttccttccttctttctctctctctctttctctctctctcatccaggctgtagtgcagtagtggcatcttggcttactgaagcctctgcctcccgatttcaagcaatattcctgcctcagcctcctgagtagctggaattacaggcacctgccaccatgcccagctaatttttgtatttttagtagagacaagtttctccacgttggccaggctggtctcaaacttctggtctcaagcagtccacctgcctgagcctcccagagtactaggattacaggtgtgagccaccacacctgcccctagggcattttctaaaaccattcagtggcagttgtttagtactacagtttccacagacaacaaaaagaataaagtagcaaataagaagctgaacaataaaccaaacaggacaaaatggagaatgaattatccttggagagctttgaagagctgtgagatattcctggaaatctaggagtcatgcacatgagaggggctttgtacatacccagcgtttgtatctgtctagaagatacaaacaaggagattagacttgagacatctaatctcccacttctggctgaccttcagctctttgcaaggaggagtgaaggctaaggcacagttgtaaactgtctggctgaatgttgaaggcacaccccacaatacacagagagcccttcagcaaaggcttggagatatttgttcaaaccatttaaagaaatctctgtccaatcacttgttgaccagtaagcttactgaccagagactttagtggtttcatatgacaaagaatgcagactatagaatgagtccatgaagccaatgtaacaacaagcaaccacaagaacaacaagctctggggaaagagaggagttctgatttccaaagttgccacactatttagaatgttaacttttaaaaaattatgagacatgcaaagaaatagtaaaatatgacccttgaacaagggaaaaaaagcaattaatagaacctgcccccgaggaagcccttacattagattttctagacaaagagtttcaattacctatttaaatatatttaaattaataaatgagaccatgtctaaagaacttaagaaatgaatgagaacagtgtctcacaaaatagacaatatcaataaagagatagattttttttaaaggaatcaactgaaacttgcagttggaagttgcagtataataactgaaatgaaaaacttactactgggggttcagcaccatattgtactgggaaaataaatgaccagcaaatttaaagacaagtgaattgagatcattcaatctgagggaaataaagaataatgattgagaaaaatgaacagaacctcagatacctgtgggatatcatcaagcataagagcatatacagaatgagaacctcagaagaagagagtgagacaggaaagaaagaatatttgaagaaataatggccaagaaattggcaaatttggtgaaaaacatgaatctgcacatccaagaagttaaatttagagatacatgcctaaccatatgagtctaatgaaagaaaataacagagataatcttgtaaaaaataagagaaaaatgaaagaagagaaatgaatgaaaacagtcacaacatactaaatcttatgggatgctgctaaaacagtgtttggaaggaaatttgtagcttcaaattcctatgttaaaaaagaacaaagatatcaaatcaataaccaaactttccaacttaagacacttgaaaaacaagagcaaactaaagaaacaaaagtaaagaaataataaagactaaagaggaaataaatgaaatggagaacagaaaaagaatataataataaggcagccttgtcaaaataacaagacagtcattgaaaccaaacatctgttcttcataaagttaaacaaaattgacaaacccttagctagactgaccgtgagactacttgaattactaaaatcaggaatgaaataggggacattactactaatcctagagaaataaaactgattataatgaaatactaaatatagttgaccctcaaacaatatgggttcaaaacgcagaggtccagttacaggcagactttttctctttgatttggatagaaaaatacagtatttgtgggatgtgaaattcacacacatggagggccaacttttcatatgtacgtacattcacataaaacttgttcacaaatgttcatggttgcataaaccagattcagaggtcacatgtgtttccatttatgagaaatgtctagagtaggcaagttcatggaaatagaaaatagattagtggttatctgggtgttgggaggaagtggtaatggggtgtaatgctaatggggtttgggtttcttttgggggtgatgaaaatgttctgcaactgtacagtggtgatagttgcacaactttgtgaatatactaaaagcccgaattgtacactttaaaatggtgcattttattatgtctcagtccatttgtgtcaccataaaggaatacccaatgctaggtgatttatgaagaagagaggtttatttggctcatggttctgcaggctgtataggaagcatggcatcagcatctgcttctggtgagcacctcaggaagcttccagtggtggcagaagaagaaagggagtcagtgtgtcacacctcacctccaacattggggatcaaatttcaacatgagattttgaggagatagatacccaaactatattatatggtgatatcaattcagtgataataataagcacctaataaagatattgtcacaattaaaccctcaagcagaaggcttggcacatttaatgtccatgaaatttagtcttttcctttaaatgtttgaatatgatatttgtcacatttcctttagaggtaaactgatcgtgtctggaaaaatgccaattaaaatctctgactcttttcttagcataaagtatttggggacagaaggtcaataaacatttccattttttcctgtttactctttctgagtatggtgtttatcttttctatgctacggttgagctctgaatgaatttagtgttttcaaaggtgatctccctgggtatttgcagcaacttaatcctcagaagaagaaagaaatgtcattgccttgcatcctgtgttgactccaaaattcatttccttgacaccaggaatgctggacttgttcagttgttttaaggaggaaactcaatttttgattaaaaatattagtatagacaaatttgtttttccaggctttcattcagatgccagtcgagaatatacttcctgcttctggagagaagttgaggaatttgaataggcactaaagactatttagcttaacttacttttttttgtatataaagacattgaatttctgagaaaggaagtgatttgcccagtcatcctgccagtaagtggcacaattggcactagaagagtagaaagtttgggagggtggaaagggtaatgtttattatttactttgtgttgacactacattcaccatccaatttagtttttacagcaatagtctctggttggtcagtagtggaacagggatccaaactcgtttcagggttctatagctgccaattaattacacagcaaacctcttgccccttccctaatcttttagcttgtctatgaaataagagaaattctagctactcctgagtggctgtaaggattaaataaaatattaaagtgtatggggattgataaaagaggaaagaaaagaaaagaaacattcaacaggtgctgaacacctgcttttgtcctccgatttgacaccttcctctagtggccatgtgggcatagggcactggtccctacttcctgttgcacagatctctatccatttgtctgtcaagcaccatgattaatttgttttacatttgattctctccttccagctgaatccttcaaggaatttgctgaattgctcaacgaggtagaaaatgagaggatgatgatggtaagtcactaacgctgtcactgaagctgagttcatgggtgatataggggatttttcctttcctttatgcttggattgatcctatactattttgatttctgtcagatagcttcttggtgctataaaaatagttaggtaatagatctggttattatgtctcaagcttccaccctgagagtttggcattagatagagggaaattaacgtgcaaatcccatctgtgttcatttcagtgaaaaataatttcagtggatattaaactgggcctttgaacatgttgacagaaattgaggtctttagtgtttttagccaaattatccatttgttaatctttaatttgtggagtagttttacttttatagagaaaatcagtagaaaataaagatagaactcatataccacctttctctctcccattcagttttccctattattaaacatcatgtgaatgtgatacatttgttataattgatgagccaatattgaaacaatattattaactaaagttcatagtttacattagaatttactcttggtattatacattttatagatttgacaaatatataatgacatgtatccaccattacagtgtcaccatacagaatagattcatggccgtgaacatttcttttgtccaatctattcatccttctcttccttctccagtcctgaaaccctgacaaccactgatctttctttttattgtgttttgccttttccagaatgtttatagtagatatcaaacagtatgtagccatttcagattggcgtatttgacttagcaatatgcattttattttcctgtcatttatttttatcattaagtaatatcccattgtatgatttaccacagtttgtccactcacctactgagggacatcttggttattttggcaattataaggaaaactattataaacagttgtatgtaggtttttgtgttgatacaaatttccaactgatttggttaaataataaggagtgtaattgctggagtgtaaattgtcagggtatgtttaattttgtaagaaattgccaaccaacttccaaaatagctgtgccatttcgcataaccagcaatgaatcagagatcctgttgctccatgtcctcgccagctccatgttcttaccagcatttgctgttgtcagtgttctggattttagccattctcacggatgtgtagtggtatctcattactgttgtaatttgcaactccctaatcacatatcatgcagagcatctttccatatgcttaactgccatcggtatatcctttctggtgaggtatttgttcagttcttttgcctattattaaattgattttcttttgttaagttttaagagttctttgtatattttagattccagacctttatccaataggcatttgcaaagattttctcctcgtctgtggcttgtctttttattttcttaatagtctcttttgcattgcataggtttttaattttaatgaagtccaacttacacatttttgctttaatggatcatacttttggtgttatatctaaaaagtcttttccaaatccaaggtcacccagattttctcctatgttatatttttggaattttttagctttttgttttacatttaggtcaatgattcattttgaattaatttttatgaaggatataaggtctgtgtctagattcactgttttgcatgtggatatccagttgctccaacactgttttttgaaaatactattctttctccttgaattaccttttgtcctttatcaaagatcacttgactatatttatatgggtctgtatctgggctctctatttctgttgcattgatctatttatctattctttcacaaataccacactatcttcattactttagcatggtagtaattgcactgtagtaaaaagcattgaagtcaggtataagcttaagaatcagtttgttcatatccacaaaataacttgctgggattttgactgggattgcttttaagatcctagagatatctttttgattttgattaggatttgcttttaagctaccagggaaaaactgatatcttaaaaatattgacttttcctaattataaacgtgggttatctctccatttatttatatcttttttgatttttttcatcagagttttgtagtttccttatatagatattttatgtattttgctagatttctacttaagtgtttcatttttatgaagtctaattattttaacagcctaaaaataatctttttgtgtggtccttagaccggcagtaccatcatgaccagcaccagcagaaaattattggaaatactggtccttgtacccatcccagacttattggggacttaaatgttgaaatgtatgcgttgatcaatattcatttttattaggggcatgatggtaagatgggaattctgttttacttttctccatcagatgactttttgtgggcttctcagttttgttaaagctatttattccaacagccagaactaatttacctataaaatccctttcttttcaacagtgtggtactgacttctcaaaatactgctcatagaatctagactcctagagaagtaggaatgaaggcaggacttggaggtaggggaattagagaattaaggctctaattctggatctgtcactaacttgttgacttcagattaattacttcatttttctgggctcctttttcttatttgtagagtgaggaaaataatccccatctcttatggttgtttaaagtgctccaaataacatagtaaacatggacgtgttttataaggggaaaatactgattatgtaagcatggtttttagttatctttagttactcacaggattctgcttgtggaaatatgatttgggaattttcttagtttaaaatatttgcttttaaatgtactaagaagagaccaatatgtgtggtttccctggaccctcttagatggcccccttgctaatacacagtctactaaatgttcttctctgcccacagggtttgtggactgctgcctatgttgttttcaaaggcatttgcccccatttcattcagatagcactagaaagctcagctgtacttctctttagccctagttgtttctccatctcttttatttacccaataacaaagccctcacatattgaagtagtattcatcttttgagatgttgtttttctcacccttcctgctgatactttgccacatgactgactcattttcttctgtctttaattatgttgtgcccttttgtcccaacaacttttcaatcgtatattgagtgtttgctccctatttcccacttaattccaggaatgctgagatggttaggcttaatgagtgcctttcaccccatgccaggaattcattgcttgattataacttttccatttcctggctttgtagcaaaaggacccctctaccccagtctggataatttagtgggtcttatattgcattttatcctttgtaaaagaagagtccaaagtaagctttagaataacagtaagaaagttcacagcactcaagcatggaaattgcctgtgtctggtcatctccataaatgaatataaattggggaaggaattatgatggggagaagtgaggaagggcatccctgtgatgttctcaaaagtatactgttggggctgggtgcggtggctcacgcttttaatcctagctctttgggaggctgaggcaggcagatcgcttgaggccaggagttcaagagcagcctggtcaacatggtgaaatcccgtctctactaaaaatacaaaaattagctgggcgttatcgtgcatctctagtcccagctactcgggaggctgaggtgggaggatcacctgaacctgaggaggtcaaggctgcagtgagccatgatcatgccactgtactacagcctgggcgagtaaggccctgccaaaaaaaaaaaaaaaaaaaaaaaaaaaaaaaaaagagcgggggagggccttgaaaagtctgaattgcacacttcttatatgattatgaagcttgcctagattcctttctgactctgaaggggcctctgttggcaatgtgcaaggtctgtttttgaagacggccaaaagtgacctaaagaggcccccataatatttcagcctgtctttagtgctctttttttaaaaaaaaattttttttattttattttttgtgacggagtctccctctgttgcccaggctggagtgcagtggcgtgatttcggctcactgcagcctccgcctcctgggttcaagtgattctcctgcctcagcctcctgagtagctgggactacaggcacccaccaccatgcccagctaatttttgtatttttagtagagatggggttttgccatgttggccaggctagcctggaactcctggcctcagctgatccacccgccttggcctcccaaagtgctgggattacaggcgcaagccactgcgcctggcccagtgctctcttttgatatttcatttaccatcaaagattcctgagcagtcctgcaatactggactgaatatcatctctattctgctcaacaccttcagtgttactttggcctttattcaataggattctgatgatagaaactcactaatgagtttaggatgtcactcgttatggtgaagagtctacctgaggtagcaggtgggagtttttgtccccagtgagctcacacaatgaatgcagtgattagaaaagagattaaaggccaaatttacttcaaaggggagtcattgctagagttctaaggggtttaagaataaaatggagtgaaaaagaaaaaagaggaaatcctcaatgtgacttttttctacattcctaagtctctattctgaccagaaaatagtataataaccaatgagtgtcatagagaggaaaagattcagagtatctgtttgtgctgtaggagactgggagcagtgttgccaaagtgattaagggaaaatgatgtcctgcaattctagtaaagcatggactatttttcagactgaactggggtcaaacatgtaaaagtcagtggccttatggaccctgtgagagaagttgctgacacacttgcttatgcaggacaatcccctttggagcatgaaaagccagcaactctgccctcctgggggttcctgaatatgcaagggcccagctccatacagtgctttagaaagtagtatgtacacttcttattcaaaggaaaacttcctcaatgtttcacagttggccacttcttaggtattacatttatttatttatttatttgtttttgagactgagtcttactctgtcacccaggctggagagcagtggcacagtcttggctcactgcaacctccgcctcctgggttcaagtgattctcctgcctcagcctcccgagtagctgggattacaggcatgtgccacctcgcccggctagttttttgtatttgtagcagagacggggtttcaccattttgaccaggctggtctcgaacccctgaccttaggtgattcacctgcctcggcttcccaaagtgctaggattacaggtgtgagccactgcacctggcctgtattacatttttttaaactgcaaattgtctttctaattatctattgcttcataacaactttttctaatattagtggctgaaaccagggtccccaacccctagcctgcagggcaccagtctgtggcctgttaggagcctgaccacacagcaggaggtgagcagcaggatagggagcattactgcttgagctctgcctgctatcagatcagtggcagcattagattctcataggagcaaaccctgttgtgaactgggcatgcaggatctaggttgcatgctgtttatgacaatctaatgcctgatgatctgaggttgaatagtttcatcctgaaaccatctccacctccccctaccctgggtccattgaaaaattgtcttccatgattctgctccctggtgccaaaaaggttgcagattactggcttaaactaaaactaattatttgtaattattttttgggttaggcattcagacgggtcagctgggcgattcttctgctccaaatgatggcatttacctggcagatgagttgatatggagggtccaaaatggttttcctaatgtttggcaccttccagtggggatggcaggaagggcggattcagctggtatgagacattgactagaatttggcctcttctgtttggtaatctcagggtaattaaacttcttatgtactgtctcaaggctcctagtgggagtattccaagagaactgggagagaactggtgctggccttttatgacctagcttcaaatgtcacagagtgttacttctggagtactctatttgttcaaaatattaacaagcccactcacattcaaggtagaggggacatagacctcacctctcaatggaaggtatgtcagagtttgtggccatgttttaaagcttccacaatagtaaaggagaaaaatgactttctgtactggacctatgacaccaataacttaatttgtgggtatttttagtagaagaagtcttattttcaattaaggagagtcactggtgtaatttttttttgataccataattgttagtggagctttgatttcctaagcaaccaaaatgaatctttctatgaatcagacctgcatagagaagtctttactaggggctcttgcagggtggaatttatagactttcctgcctttggcaaatgagcacactcagagataaagagaatgttaagtgtcgtactgggaggtaggttatagtacgattaggactcaatggggtttcatagatccagtagaagagaagagatgtgatgagaatcagacagggtctggaaatgttagcaggcaagaggtctgattttgtaaaaatcagcaaactttgggaagggtttcatgattttttaagtctaggcttgtagcaaacaagttttagaaagccaactataaaagcactggtgatcaggagacatagagaatgactctgttctcaaggaaaacattttttttcttgcctagttttatatttttttttgctgggtgctggctgtcctggatgatagcattaggagctgcagtagatcagaatgtcagggttcaccaagatgttctcatacaaaggctggcagtgccattttaggagttttcccatttagttgaaccttgaatcatacctatacacagaacaagaggcccaaattacctgaaagacacgtataacctatgcactaatgccccacaactttccacacttttggggaggtaggttaaaaattgcttcttagattggagaactcagatcttgtcaaaactggctttttcctctgttgtctatttttgttatgaagatatatcttgtcttactgacacctatgtctcatatgacaaggaaacttgtcttttagttttctgtcttgtaattaataaaaattaatgcaatgattcccaaaatgcagccctttagatgccttctctagggtcttccattttagtgattctaactctcaccatggaggcacaaaccccacttgttgccttgaacatatacaatctcataagaggtttatatgaagaaaaagctttgtatacctttacctgcccaaagaacaaggggtcttctttgattttgatgttttcatatctccagaacatatttattattgccaatattaatagtccctgaacaggccattcctattagcttctgagcatttatatttaggtaatttgaaagcctagtctagtgttttctgcgatgctgtaatgcactccatattctgaaggaaatgttctggttttatggcacaggcaggactgtaaatgttttatcctaatgctatcactgcacactcatttgcctctgatgaaatgatttgcacttgctgcaattgtccttttcttgtatttgccattctctttctcttctctttttcacctgtccttcaggtctcctgtgtcctctgctggacatcacttcagatatttatcgattaaaaactcaggtcagactatcattaaagttacagagaaatgcccctcttattctttctcccatttcttctcaatgcatttgatttttcagaaacaatatagaaacaaacagtaacaaaacccaacaaatcagcaaaccatttaacattttgcaggttggtatataaatgaaaatgtagtaacaaggaatcttgtatctgaaccttgttaacctagaaattgttttgtttgtttttcctttttgtctaggtacacaatgctagtgatttgctgattaaacccttggaaaatttccggaaggaacaaataggcttcaccaaggtacattttctgtatatgcataagattttttaaaatagcaatcgaatagttgtatgggctactattcttcactttacaaagatatgcaccaatctgctggtgctttgctcttggcctagtcagcctcctaaactgtgcaaaataaatgtttgttgtttatgtcaccctgtctatggcattctgttatagtagcctcagctaacatgacaaagggggtggggaggtgggtgattagtttctatgagaaaatgatcacgaaagagagtaagaaaatctagaattggcctctgactttgtggccaacaggctctgtatctgtgcataagtttcttcttcttttggtgtttttgttgttttgtctggaaaactagctagctatcatgtatcaactgcctgctatattgagcactaggctaggtgctttacgttcattctttaatcacaaggactttgtgtgcttctggcattttccccatttcacaaatgaggtaactgagccttggacaagataaataacatgaccaaagttatatagctggtgatatagtttggatctgtgtccccacctaaatttcatgttcagttgtaattcccagtgttggaggtggggcccagtgggaggtgattgcatcatgggggtggatccttcatgaatggttcagtactatcccctcgatgctgttctcctagtggtgagtgagttctcatcacatctggttgtttgaaagtatgtagcaactcccccacttcttgctcctgctctggccatgtaagatgtacctgctttcctttcaccttctgccatgattttgtttcctgagacttcaccaaaggagaagctgctgtacttcctgtacagcttgcagaactgtgagcccattaaatctcttttctttataaattacccagtctcaggtatttctttatagcagtgctagaacagactgatgtggttagtaagtgatagtggcctggatttagacctaaaggtctttttagctttacgttccatactctttacattaagctatgctgtctagatctttgctgtctattatggtaactactatctatttaaataaaattaaattaacaactcagctcctcattctttctagccacatttcaagtgctcagcagtcacttgtgtctagtagctactgtgttggacagtgcagataaaatacatttccatcattgtgcaaagttccgttggacaatactgagtgccagttaatttcattcttttcagcttgaccatcacatggatctctgtgattctccaatgtctgttgaagggatgttaataattttcatttttaatcttttcagctaggtgtaggtctgtttcatgagctctcaatgtgtatccaccatgtagcaaaggtagtttcttctaccagggctaaaatacagcatcttgtccaagcatctagttttcttaggactaagagcataccaaccagtagatattatttggaatatgatgacaatcagtttggatcaagaatttgaaaacagcaagtttttctttttttaaaagacactttcttgccaactcagcctcccaaagtgctggtattacaggcatgagccaccatgcctggccatgaaagtaccaaattttgagaagaaagagcaaattagtggttgagctcccactacctgctatcatcagattgacatgggcattgttagaaatgactggtgttcaagcaaagtgagttcccctcatagcccagcaatacttgtttcactggagtctcattaacatcaatacttagttgggagaggatatgattgaagaatagaagtatatttaaaattacaactgaggataaaaatacttaaccacttgtgaaacaatttgatttactttcattcccttataagaataacactaggaaagtaaggatatgctaccatggttgccctcatattatctgagcaaatggaaatgaatttgtattatgtgcagtcatgcgtcgcctaatgttgttctgagaaatgcatcattacatgttttcatggttgtgtgaacttcataggagtttgcttaacacaaacctcgatggtctagcctaatacacaactaggctatatggtatagcctattgctcctaggctacaaacttgtacgggtgttaactgtactgaataatataggcagttataacccaatggtaagtatttgtttatctaaacatataaagcatacatataaaaatactgtattataatcttataggactgtcattgtatatgcggttcattgtttactaaaacattgttttgtggtgcatgactgcacttcctatggcccatgcctgcactgagggttttacatatgctttcttccttaattctcacagcaaacctgtgaggtaggatttttaatatccattgtctcaatgaagaaagtgagtctcagaaaggttaaatatgtatctatcttttttcatacttctttaccagtaaggccaacctgcatatctacaaagaagaccaacttagtatgagtcatgtctccaataaactatctagaattccaatagtcaaaatgaagcttataggctacccctgtgtgttatcaatttattgccaatcaattccaagcctctcaatacctgctctgtgataatggacagattttctttaagcatctttcctttatagtgagcacactcttaaactttctcagtagagggagctggaggacgttgcaggaggaagggggatctcttgaagtttccagctgaggcggggttggggcagggtggggaggacagcttgatggaactctgacccagccacccacccagacacatggtgcctcaatctccttgaagccttcatgaccatgctgtccctcagcttccttctgtagaccccctaccccacatggcccacttgctggctgaagagttatcatgcagctattaccctctctgcagggccctcatacattgagcttgcaccctagggggttctcaccaaacaaggctggccccgttgagctcacctgcaactcagttttcccaccttctctttataccttctccgctggtcactgttggcctgcttttttgtaatctggtgagttgcctcctgcttacatagtaactatgaaccaccgggccaaatcagcaaacattctgctatccggagtgttaaattactccttttctttttttgtgagacagggtgggtctcactctgtcacccatactgaggtgcagtggcagaatcatggctcacttcagcctcaacctccctgggctcaggtgatcctctcacctcagcctctcaagttgctgggactacaggcacataccaccatgcctggctaattttttttttttttttgtaatttctgtagagatagggtttcgccatgttgcccagactggtctcgaatgcctgagctcaagcagccctcctggcttggcctcccaaagtgttagaattacaggcgtgagctaccacgccccaccaaattactgcttttcaagtgaggtctgaaccccattaaaatttctccttatttgagtacttttccttaaacttagagtaccatatagagttttcttatatgtcaattatttgtaaggttttctatctcctgattggacttagcctggtatacccagcactgctgctagctggctttgtgagttcactggttgtgataggtgctatattaggcccttactcatacatatccagttctcatttgaacctcagaacaatcttgcaaaagttattatcccccattaacaggtggggacactaagttcagtgaggtgtagcctctaaggtcactcagtagcttggatatgaattgagatctggttgtaagtctagggctcatttcactttgcaggaaacagcacttctctccgaaccttagttttctcatggctcatgacaacaagaacaatggacaaatattccaaatctgatcttctgttagtttgagattctttttttttaattattattataatttaagttctagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccagtgtgtgatgttccccttcctgtgtccatgtgttctcattgttcaattcccacctatgagtgagaacatgtggtgtttggttttttgtccttgtgataatttgctgagaataatggtttccagcttcatccatgtccccacaaaggacatgaactcatccttttttatggctacatagtattccatggtgtatatgtgccacattttcttagtccagtctatcattgatggacatttgggttggttccaagtctttgctattgtgaatagtgccgcaataaacatatgtgtgcatgtgtctttatagcagcatgacttataatcctttgggtatatacccagtaatgggatggctgggtgaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgtttttttcttgtaaatttgtttgagttcattgtagattctggatattagccctttgtcagatgagtagactgcaaaatttttctcccattctgtaggttgcctgttcgctctgatggtagtttcttttgctgtgcagcagctcttgagtttaattagatcccatttgtcaattttggcttttgttgccattgcttttggtgttttagacatgaagtccttgcccatgcctatgtcctgaatggtattgcctgagttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcatatggttgtatatatgtggcattatttctgagggctctgttctgttccattggtctatatctctgttttggtaccaataccatgctgttttggttactgaagccttgtagtatagtttgaagtcaggtagcatgatgcctccagctttgttcttttggcttaggattgacttggcgatgtgggctcttttttggttccatatgaacttcaaagtagttttttccaattctgtgaagaaagtctttggtagcttgatggagatggcattgaatctataaattaccttgggcagtatggccattttcacgatattgattcttcctacccatgaggatggaatgttcttccatttatttgtattctctttgatttcattgagcagtggtttctagttctccttgaagaggtccttcatgtcccttgtaagttggattcctaggtattttattctctttgaagcaattgtgaatgggagttcactcatgatttggctctctgtctgttattggtgcataagaatgcttatgatttttgcacattgattttgtatcctgagactttgctgaagttgcctatcagctaaaggagattttgggctaagacagtgcggttttttaggtatacaatcgtgtcatctgcaaacagggacaatttgacttcctcttttcctaattgaataccctttatttccttctcctgcctgattgcccttgccagaacttccaaaactatgttgaataggagtggtgagagagggcatccctgtcttgtgccagttttcaaagggaatgcttccagtttttgcccattcagtatgatattgtctgtgggtttgtcatagatagctcttattattttgagatacgtcccatcaatgcctaatttattgagagtctttagcatgaagcgttgttgaattttgtcaaaggccttttctgcatctattgagataatcatatggtttttgtcattggttctgtttatatgctggattacgtttattgatttgcatatgttgaaccagccttgcatcccagggatgaagcccacttgatcatgatagataagctttttgatgtgctgctggattcggtttgccagtattttactgaggatttttgcatttacgttcatcagggatattggtctaaaattctctttttttgttgtgtctctgcctggctttggtatcagaatgatgctggcctcataaaatgagttagggaggattccttcttttttattgactggaatagtttcagaaggaatggtacgagctgctccttgtacctctgtattctgtacctctgtattctgtattctgtacctctgtattctgtacctctgtattctgtagaattcggctgtgaatgcatctgctcctggactttttttggttggtaagctattaattattgcctcaatttcagacctgttactggtctattcagagattcaactccttcctggtttagtcttgggagggtatatgtgtcgaggaatttatccatttcttctagattttctagtttatttgcatagaggtgtttatagtattctctgatggtagtttgtatttctgtgggatcggtggtgatatcccctttatcattttttgttgcatctatttgatacttctctcttttattctttattagtcttgctagcggtctatcagttttgttgatcttttcaaaaaaccagctcctggattcattgatttctttgaagcattttttgtgtctctgtttccttcagttctgctctgatcttcattaactatttgttgccttctgctggcttttgaatgtgtttgctcttgcttctctagttcttttaattgtgatgttaaggtatcaattttagatctttcctgctttctcttgtgggcatttagtgctatcagtttccctctacacactgctttgaatgtgtcccagagattctggtatgttgcgtctttgttctcattggtttcaaagaacatctttatttctgccttcatttcgttatgtacccagtagtcattcgggagcaggtcgttcagtttccatgtagttgagcggttttgagtgagtttcttaatcctgagttctagtttgattgcactgtggtctgagagatagtttgttataatttctgttcttttacatgtgctgaggagtgctttacttccaactatgtggtcaattttggagtaggtgtggtgtggtgctgagaagaatgtatattctgttgatttggggtggggagttctgtagatgtctattaggtctgcttgctgcagagctgagttcaattcctggatatccttgttaactttctgtctctttgatctgtctaatgttgacagtggagtgttaaagtctcccattattattgtgtgggagtctaagtctctttctcgatctctaaggacttgctttatgaatctgtgtgctcctgtattgggtgcatatatatttaggatagttagctcttcttgttaaattgatccctttaccattatgtaatggccttctttgtctcttttgatctttgttggtttaaagtctgttttatcagagactaggattgcaaaccctgcttttttttgctttccatgtgcttgggagatcttcttccatccctttattttgagcctatgtgtgtctctgcacgagagatgggtctcctgaatacagcacactgatgggtcttgactctttatccaatttgccagtctgtgtcttttaattgcagcatttagcccattcacattaaggttaatattgttacgtgtaaatttgatcctgtcattacgatgttagctagtgattttgctcgttagttgatgcagtttcttcctagcattgatagtctttacaatttggcatgtttttgcagtggctggtaccggttgttcctttccatgtttagtgcttccttcaggagctcttgtaggggaggcctggtggtgacaaaatctctcagcatttgcttgtctgtaaaggattttatttctcctttactcatgaagcttagtttggctggatatgaaattctgggttgagaattcttttccttaagaatgttgaatattggcccccactctcttttggcttctagagtttctgccgagcgatcagctgttagtctgagggacttccctttgtgggtaacccgacctttctttctggctgcccttaacattttttccttcatgtgaactttggtgaatctgacaattatgtgtcttggagttgctcttctcgaggagtatctttgtggcgttctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgtttgtttctttttattcttttttctctaaacctctcttctcacttcatttcattcatttgatcttccgtcactgataccctttcttccacttgatcgaattggctacagaggcttgtgcattcatcatgtagttcttgtgccttgactttcagctccttcaggtcctttaaggagttctctgcattggttattctagttagccattcatctaattttttttcaaggtttttaacttctttgccatgggttcaaacttcctcctttagctcggagtagtttgatcatctgaagccttcttctctcaactcgtcaaagtcattcttcatccatctttgttctgatgctggtgaggagctgcattcctttggaggaggagaggtgctctgagttttagagtttccagtttttcttctctgttttttccccatctttgtggttttatctacctttggtctttgatgattttgacgtacagatggggttttggtgtggatgtcctttctgtttgttagttttccttgtaacagtcaggaccctcagcttcaggtctgttggagtttgttggaggtccactccagaccctgtttgcctggtttcggcagcagaggttgcagaacagcagatattgacaaacatcaaatgttgctgcctgatcattcctctggaagttttgtctcagaggagtacctggctgtgtgaggtgtcagtctgtccctactgggggatgcctcccagttaggctacttgggggtcagggacccacttgaggaggcagtctgtctgttctcagatctccagctgcgtgctgggaaaactgctagtctcttcaaagctgtcagacagggacatttaagtctgcagaagattctgctgccttttgtttggcaataccctgcccccagaggtggagtctacagaggcaggcaggcctccttgagctgcggtgggctccacccagtttgagcttcccggctgctttgtttacctactcaagcataggggcaatggcgggcgcccctcccccagcctcgctgctgccttgcagtttgatctcagactgctgtgctagcagtgagtgaggctctgtgggcgtaggaccctccaagccatgcatgggatataatctcctggtgtgtcgtttgctaagaccgttggaaaagcacagtattagggtgggagtgacccgattttccaggggctgtctgtcactcctttctttgactaggaaagggaattccctgaccccttgcacttcccgggtgaggcaatgcctcgccctgctttggctcatgcttggtgcactgcacccactgtcctgcacccactttctgacactccccagtgagatgaacccagtacctcagttggaaatgcagaaatcacccatcttctacgtcgcacacactgggagctgtagactggagctgttcctattgggccatcttggctttaccctgatttgcatttctctaatggccagtgatgatgagcattttttcatgtgtcttttggctgcataaatgtcttctcttgagaagtgtctgttcatatcctttgctcactttttgatggggttgtttgtttttttcttgtaaatttgtttgagttctttgtagattctagatattagccctttgtcagatgagtagattgcaaaaattttctcccattctgtagggtgcctgttcactctgatgataggtccttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataagatgtaaggaagggatccagtttcagctgcctacatatgggtagccagttttcccagcacctagtttgagattctgagggtaattaactaaatatttgtccgctgagtactagaaatacagtacacagaactcgttgcactgtaagtggaaaatataccctaaaatatactctggattttgaagacagtttgaaaaaatagaaaatattaacatttaattttgattatatgtttaagtgataatatttgaccacttatttattttttctttttgaaatgtgactactaaacattttaaaattacgtgtggcttgcattatctttctattggataacactgacctagacaaagaaattacatttgataggtagctcctgcccatttggtagatagttcatgggctttatcaggctttagaatcaagaggaggaagtatttgatgaaaattcatatacagatagttatttaattaattaaattagttaacatatataaagttcttagtacagtacctggcaaataatatgcactaaataagtttctttcatcaattatatgtgctaaaaaattttctttcatcactgtaattcttgttagtactggtaatagaatagggaggatagaaagtgctccatgaaactgtccgattgacgatggacttactgtgaattaaaaatcaaaaaagaactgagaagttaatgaatgaggcaggaacagagggataggggtgttgaacattgagtgtttcccaagtggctactggcatatgaagaggtttcatattactaggtctcccagtatgtgtctctggctttgcaggatgtgggaggatatctctttgtcatagaagtggaggttcgtagggaggaaggatgaaagcaatgaaggaaggaacaaaataacacagagaatgctctgaactaatagtgaacacattccatataaactcatcctgttattcaagcaggattaacttcttcaagtggcattgatgcttcaagtggcactttaccttggatgtgttttctatagtggaatttgggggcaacatgtcttttataacagaactctattggttaaaaatatttgtaaaccacctccttatggttaaaccagatagatcttcctgttttcaattaaataggttatgtctttcaacttctgtatggagttggtatatttatgcaatgagatggacatttgttcctttcctttcctgtcctgtcctgtcctgtcctgtcctgtcctgtcctgtcctttcctttcttgtcctgtcctgtcctgtcctgtcctttccgttctgtcggactttcgctcttgttgcccaggctggagtgcaatgacgtgatctcagctcaccgcaacctccgcctcccgggttcaagcgcttcttttccctcagccttccaagtagcttgaattacaggcatgtgccaccacacctacctaattttatttgtatttttagtagagatggggtttctccatgttggtcaggctggtctcgaactcctgacctcaggtgatccacccaccttggcctcccaaagttctgggattataggggtgagccaccacgcccagctggacatttgttttttttctaactttaatgtgtgatctgcagtttcatcagactaaccctatttcacaatccttactttttgagaaaataattaatgctaacttttccattttaaaaattaaaattttataacagatatatgcatagacatatttttaaaaataaaatagtaatacagagtccacaaagaaaatcaaaagtcttctcatgtttatccactactcagaggtatccactgttaaccatttatgtttcattcttagttatttttatattttaaaatgcttatattgctatgttttattttagtttaaaaattatttctccatgctgagaatacaggagatcattgctcacacttcccccttactttccctcttcttccactctttgataattataagaccattttacttcttgtactgcttacttctgttattttaaataatatacttaaactcttatttcttatttcatcaacttttgactctagctttgtaagatgaagatattagcacttctgtcttgcttaacccttttagccctcaactcccatcaaccacaccttcatttttcattttaggggttataacattactattctagtctggaaccttaatgtaatcttattgatattattaatagacttatttgacagtggcaaaaagaagtggacaatccaggatttgaacccaagttctttggctgcgagtccatgaattttgacatatcttatattgggttaatgtaagagttaatttctggagccaacgatagatgaaggatgattcctttctttgcccctttttcctaatttcttctctactatgtttaaagttctttgagcagccacactctagatttctttttggttcactcctatccctcccacctctcaaaattcccaacacatgcaaagtttgtgcatccttccccatgtgtacactttatcacttgatttgcagaactgttctcaccactattcgccttcctataatcatgcaacttccccgcctccccccaccgacttctctgacccaagattaagggaggacaagcaagtcttagtccagctctgtttataatgggtctttcatcccgcagtgtagaatgctagactgtccagtagggatggcagaataaagactcagtcatcccctctagccttatgacagggagggtatttgtaccctttgattcatattttttgggtcttgtcagagttgcccacagtatgatgttttcagttctttttcaagggtgcccttgccagagaggaacagccactgaattgagcttttttgtggtttctggtgggaccagggccaaattgtctgactaagacatctgagtctgcatttaacccacttcatggagagtgggagctagtgtggaagctatgatatagtgtgttctcacccaagagatggcaggcaagagggcattgatgacaggacatgggattgtcagtcttaatgatgtttctcatccatgtacagttatcacagaaagaactttaagaaaaggacctgttctggaggtagatgagactgaaaacgtatcaaagatggcacaaacctgacagtgtagatgaagacaaaggtgttagtgttggtctgcattccaaaggccagtgcttgctctgggaaagaggggaaggaaacatcagcaaaccacccattgatagatccaaataatttgaatttccatgtttgggtttcaatggctaccagagtgcattagcagggaagatcaagtggccaaggtgctaaagaattaagctatgtgacagtaatccgtaagtgatttccaagtctgtagcaaacattttataagccttacaataataactaccatgtactaggtacttggtttatgtcctttcaattattattatttgtatcctacagatgtggaagtcaagacccataatggccaaataacttgtagaaggacacatagttattaacagaagctagtttaaaacagatttttgttactccagggactgtgctctttctactaccctgcactctgaaccctgctttgtggggctcgtatcagaagattaaaaaaaagattaataatgcctgtcaccagttcaatggatatatacattgtggcaaattgtcattattctatagcaatgagaacaaatgaactagagctgttgttcaccgtaacatagatgaatctgagaaatacaaggttgagttaaaaaaaaacagtcacgaaagattacctgctatatgagtccatttctataaagtgcaaaaacaggtaaaactaagtgatgatgttagaagccaggttagtggttacctccaagagtcggggtgttactgaaaaaaaaaaaagaatcacaaaggggctttcaagggttcaggtaatattttgttgttttgaccttgggtgctgatgacatgggtgtgttcagtttgtgaaaattttttgacatttgtatagtgtatttttcagagtatatgttataatttcaaaaaatggaaaagaacattagaaaaccttaatatctcctttgtagcaccttccaccagcaatccgtgtttcttcatacatggagacaatggctttatgggtttatcctcctgattatcctcatatatggaccttcttcctctatgatgactttccttcccttttatctcataggtgaatttccctaagcagtatatagtattgttttacataatatactggttaagacagtggactctggagccagactacctgggtttgcatcttggctcttcaacttagtagctggtgagtgtaggcaagtcacttaacttctttttgccttagtttcattatctataatatgggataaattatagtacttaccacatagagttgtggggataaaatgccttattatgtgtaaaatgctcagaatagtttggtacatatagtacataacatacaaatgtttgctactactgattttcatatttataaaaaaggaatgatctgcaggtgctcttttatatattgctttttttctcatgatttcttaaacaattatcttttttttgagacaaggctttgctttgttgcccagggtggagtacagtggcacaatcacagctcactatagccttaaactcccaggctcaagcaatcttcccattgcagccacccgagtagctgaaactataggcatgtaccaccaaacctcacaaatttttaatatttttgttgagatgaggtctccctgtattgcccagactggtctcgaactcctggtctcaagtgatcctccagccttggcctcccaaagtgtttggattgtgaggcattgtgccaggctcattctcttattgatggatgagtcatttgcttccattttttatgtgagtgcaaacaatactcctgtgacagtgatttacatgtctccttgtgcatatttcaactcttctcctgggtatatacttagaaatagaatttctatgttgtagaatctatgcatttttactagatgtgttgccaaattggtctacaaaatggttgtgtcaatttatatcatcactcatcactagcagtataaaagtgttttatttgctgcatatccaaggaaaatgagttagttcagaaagatgcaagagaatttgattcagcaagtgtgtattgtgtctctaatctgtatatagagaaggaagcagtcactggtggaagagaaatttgctgtacagacacagagcagctctacttaataccaaccacatatgtaaagtatctggcatagagtaaacccctttgctcaagcaatctgggaatgtacccacacagctgatgtggtaatgttattaccctcttacaaggtaatctatgtctgaaaaataatgtggcacatatacaccatggaatactatgcagccataaaaaatgatgagttcatgtcctttgtagggacacggatgaagctggaaaccatcattctcagcaaactatcgcaaggacaaaaaaccaaacactgcgtgttctgactcataggtgggaattgaacaatgagaacacacggacacaggaaggggaacatcacacacaggggcctgttgtggggtggggggttggaggaggggggaggggggaggggtagcattaggagatatacctaatgttaaatgacgagttaatgggtgcagcacaccaacatggcacatgtatacatatggaactaacctgcacgttgtacacatgtaccctaaaacttaaataaataaaaaaataaataaataaaagaataatggccacatttagcctgaagagtagagggtggaaagggaatattatcttgttgtcagtgacatagaatggaccatgacccaggatgaggtcatattttttccatctcccttgccatccttcactagagtagaagggaattgcatcaaagagcggagagacactagttttctcttcccgtctataaccaaagtgaaactgttatctgccccttctccctatcccggtgccctttctacttgaactatttgagagcatttttgtaattacaagggtgatctcgctgaaatgaggtttccttttgtgagcttgtaactcggttcctaatattagctggcttcaaagtcatgtctggagttgacaggagatacaggaaatcaagagcatgtatctccctaaattggattgtaatttggggattccctgtttttggaggaaatgtcaaatgttctatatctgagttttccactacaatagcttctagcaacgtgtagctactacatacttgaaaggttactagtgtaactgaaaaactgtattttaaattttagttgattttagttaatttaaggtaatgtagccacctgtggctattggtagctgtgtaggtctaataaatattttgttggtagaggaaggtaagggagctaatatttttttttcagtacctgctatgcattggggtctatactgccatctaatttttacagtaccctgtgaagattttatcccccattttacagaacaggaaaccagagctcagagaggatgacctacttgttcaaggtcacacaggctacaaaatggcagagccaggatttaaatacaggtctttctggtctctccaattccaaagtccattctctttatcctgaacagggtggtataattttgttcttgctacttggcttcagccatatgccagaaaagcttaaaattgaatgccttctaacagtaattccatattcttaactgttaatttgcattagcaaatgggtttctggaagctctaataaatgcataccttgcagatattgtgtgttcagttccagaccattgtaatgaagtgaatagtgcaataaaatgagtcacaaaaattttgctttccaagtgcataaaagagttacatttacaccgtactgtagtctattaaaggttcaatagcattatgtctttttttttgtctttttttttttttaattttttttgagatggagtctcgctctgtcacccaggctggagtgccatagtgcagtctcagctcactgcaacctccgcctcccgggttcaagcagttctcctgactcagcctcccgagtagctgggattacaggagtgtgccaccacacccagctaatttttgtaattttagtagagacggggtttcaccatgttggccaggctggtctcaaactgctgacctcaagtgatccacccacctcggcctcccaaagtgctgggattacagatgtgagccactgtgcctggccctcaatagcattatgtctaaaaacaaaatgtatatgtaaaattaaaaaacaaactttattgctaaaaaaatgatgctgacacagagacatgaagtcagcacatgctgttggaaaaatgatgctggtacacttgatccatgccaggttgacacaaaccttcaatttgtaaaaaattcagtaactgtgaagcataataaagcaaagcataataaaaatgaggtgtgcctgtatattaagattccagggactttggtaatgatataggagttaagaagaaatcacttaggcagatagtaagggtataggagtccttggtaagacttttctttttaatgaaaagcagcctcaaatcattttctaacaatgcgcagcctgtaaagtcgagctgcagacatagacaagcaagctgagagcttgcatgagtgaatgctggcaggaactagagactagatatgttcaagatggctcctccatcatcctttctctgccagccatgtgtacagtaagaagcagacaagatagtgcccgccaaggagaattcatttgtggaataagattagggcggtgagaccagccttccccttgctcctgatcaaaccaatctgtgagccctacctaaatcagacactacctcctcaagctggaccataaaatctggtgcattcgcagtgagcaggtcctttccttttggagacccccctctctctgtagagagagctgtttctctttctcctctcttctgcctgttaaacctctgctcctaagctcctcgtatgtgtccgtttcctaaattttcctggcaagagatgacaaaccccagacaacacagccacttcagtaatgactttctgtcctaggatatttgggaggaataataaatgcctaggaacaaagtgattgaatgagtcagttaggctttttgtatatttttagtcaaaaatcattataccatgtcttagggttcttcaaagagacagaacaaggggtgtgtgtgtgtgtgtgtgtgtgtttgtgtgtgtgtgtgtatgtagagcggggtttagtttaaggaattctcttatatgattgtacgggctggcaagttcaaaatctgtagggcaggctggcaagatggagactcagggaagagttgatgttgcatctcaaatccaaaggcattccctcttcctcttcctcagtcgtcttcctcagtctttttactcctgaggcctttgactgattagatgaggcccacatatccgcaagactactggtttaaatgttaatctcatctaaaaactatttctaagtaaatatctagactagtgtttgagcaaatgtttaggtaccgtggcatggccacaatgacacataaagttaatcatcaaacactatgagaacttttgttgttgatttaattactttccttttccgtattcacataacttttatttcagtatattgttataatttttgttgtgctattttagtagttattgttgctcatctcttactgtcgctaatttataaatttaactgtatcatatatatgtatgggtaagtgacttaagaactcttgaggcaggcagttagaagtttcagtcagtgtcctccaggtcttttctccgtggttctcttagacttcacctcagggtcataagatggctgtcacagctcaacatattacatactcacatgttagcatcccaagcagaaaggaagtgggggagctcttttttttttttttttttttcttgaggcagattctcgatctgcctcccagtctggagtggtgcagtcttggcttactgcaacctctgccttccaggctcaagcaattctcatgcctcagccccgcccaggtagttgagattgcaggcacatgccaccacgcctggctaatttttggattttttggcagagacggggtttcaccatgttgcccaggctggttgtgaactcctgacctcaggtgtttgggaagccgaggcttcccaaattgctgggattacaggtatgagccaccatgcccagccataaagggctcttttcacatggcatagtttgtcttttatccaagagaaaaatgtcttaccaaagttgccacctgactttccctaataactcattggcaatagcggagttgtgggcccactcctaggacaatatttaggaaaaagacataggagtactaaaattcccctttggcctgggaggggggctcacttttttttggagaacgttgcttgcctgcctgatatctgaagaaataggaagaaagaggatggctattgaattggcaatgaacagtgactgtcataatggccttttgagaatagagatgctggactctaaccaggagcctctggaatatattcaaagggcaggaaagagaaaaatactggttatctatctatagtactttaatataataatcacagaggcactttcaccatatcttgttttccaaagagagattgcctcaaagacccagagagggaatgtgacacctcctaggtcctacgggaagctagtggcagagcaaggaataatactcatattcttttgctaccttcatgctgcttgtaccacttttgttcctccagcaggtcttaagcactgttccacagtgagcaggtctatgcacacctacccctgaagtctaagaaagctgagaggcttaagaaagaagctgacatatccagtttctgagagagaaacatgtaatagatgtttacaaatagaagccatagtcttgggcagcagtgagacaagatggtggatccctgtgccgttaccccctagacgcagggcgtacataccacagggacggaatgtgtaggacaattgaagttgacctgcccggcaaaggcaagaatgctgtgtgaatctttctaagggcaggatctatggtcaaagttattctgatctacgggcaagactgataacagtagataaagtagaaatcttagaggcatttccagaacagaggttaatcagaagtcaatatagtagatttgcatccaagatggagttgctttagcttctacaggcactttaagaacatatttggcagtgatttctgcctatatgatgtaagcatattgtggtttaaaaattttaaaaaatttaactgaaattgacttattactatccatttatattgtagcttacatttagcagcagaagagaccttcaaagttattagtcccacctcactttacagttgggggaactgaggcttagaaggttaagtgactgacccaggagcatagatggttagcaggggagatgggatcagaacccaggtcgcctgattcctagtcagatgtaatcaccagttcttcagagatattccataaatataatattttgggcagagctgtatgagttttatttttgttcaaattatgctgagataaccttgtagacccaatgtcttggccctcatttaacccattcctgctttagccatttctcttcagaaagaatcagatgcacctttttgcatcacagtttccttatctgaaaaaaaatgaggataatgaactatatggtttattttacttataaagttctatgattaatacaagccaagactagagcctagctgagtctccagatttctgttttgaaaatcaaggggtgtatttttattttaataaactactaagccaatatttatccagacaacttagttaatataacttttttttttacttgcttgttttttaaccaaagtgggtgtttaaaaatttgtctttcaactggcactatgttgtcagtctcaccaggcacagcaatcttcgaggaggtccatcttccaaagccagacttcctctaaaaaaaaactccccaggaaactggcttctgctcacagtaggatatgcatgtccagaggattttttttcttatttacttatgtagcctctgtgtgtgtgagataaagctgcttctcacttccgttgacaattaggaagtggctggcattagtaggcaagtaaggggggaaaagccctgcaccccaaccagaattcaatagttaaaaggaaattgttatattgttttcaaagcatttactttcctctccttgattgtatcaaggaagatgccaattcatcatcatcattgctattcttatgaaacactcaatatgtattaaatatttatcatgcaatctcttttgagcctttcgacaactctatgatgcagtccctactgtaacatttattttgtgaggaaactgaggcaggaaaataagaactttaaacaagctggtgtttgagttcatgggtaaaccctctcattggaaaatgggaaattgttggtagatgatgttgcctgatgatatgtatggcgatttaatttgggctcagatttttagttctttaagacagtattattgccaggaaatacttttctgagaaccccagaaaaccttgcatattggttagatatcataagaataacataacaaagcatcccaaaattcagtggcataaagcaataagcatttatttctggctcacacatctatgggttggctgaggtagctttgttttttttcaattaggttcgatggggcttggctcaggccacaagttccatttaggtctgctgtatgtgtctcaatttttcagggatcagagggtcacctgaggcagattattctcaggatggtggcagaagtgcatggtgggtaagcagagacacgtgaggtctttcaaagctaggctcaaagccagcctaccattgcttccttacaaattcagttggccaaaacaaatcatatggccaagcccaacatcagtaaggaggtgaaatacattcttcctttagcagaactgcaaggtcacatggcagagtacatggatacagagaggtggggggaaatttgggaacaataattcaatctgccatgccttggctgaaaagtagtggcagtaggaagtcagaagatgagagctagaaaagatactctgatggagagtgagaggtgtagtgggaagatccttatggttaggagatctggttttgagtcctaactgtgacacttttttagtatgaccttgaacaagtcattttccttgatatttgagcattaagggtccatgtgatgtcttcatcttatattttcacttacctagataaggatgtagagtaaatgaatgcaatgattagtctatgttcaaacagctaggttgaatcagtaaagactggaactttgagttctttttccattcctcaatcttcattgctttagaagaatagttaatatttgaggaggggccaggtgcggtggctctcgcctgtaatcgcagcactttgggaggccaaggcaggtggatcacgaggtcaggagatcgagaccatcttggccaacatggtgaaatcccgtctctactaaaaatacaaaaattaactgggtgtggtggtgcgtgcctgtaatcccagctactcgggaggctaggtaggagaatcgcttgaacctgggaggtggagattgcagtgagccgagattgcgccattgtactccagcctggcaacagagtgagactccgtttccaaaaaaaaaaaaaaaaaaaaaaaacatttgaggaggggtgttgggagaggtttcagctctcctccttttctcatgaaattaaagctgttttactacaattcttctttccacattaccatgcttatctgttttccatttcttcaaagccctgaacaaggagaagtaggccaaaatcataataggaagaactgaagttcaggcagagtaagtgctttttgcatgtaactgtacttaaatgttatatattgttagggaaactggtaacattgctgtccccaaagatcttttagagaggcatctgttgctatgtgatgtgttaagtggagttattcctgaaagaagcacagtgggctagatatgactcatggcctcttctgtctttatgctattataacatatttatatgtgtttatttgtcagacattcatatcatgctcatatagtgccagatattcttctaagaagtctacaggtactaattcatttaatcctcaaaactatgagacagggagtcttacttatttctgttttacagattaaaataaacgcaaataccaaacacgaacaaggaacaacagcaacaaaaacctaaggcacagggaggtgacataactttggcacagtcaagcactagaaaggagcagagctggtacttgaacccaggttatgtgattccagagtccacgcctttagccacgtggcacataggcatcagaactgagcaggccaactctgctacttactagttctgtgacatggagtgaagtacttcactcctctgagccttgttttcaactctaaaatgtgaacaataattatatcagcctcacagggttattgtgaggattcaatgagatagtgcataaaaccatgcttggcattgaaacattagttctatttccgtgaaatacttctatacattttaaagatgactttataagtcttccttttaacttatagtttatgaactcttacaaggtttataatccttggcttgattgatttatctgtatgactgattccttagcagtctgtaagacaatttggccttgccatttctgtctaacataggaaaagagcaatgaggcaatttcccttggggcggagattaagagccagtgaccccatgtatcttggctgtctgagaagttgctgaactgtgccatctcctttttccacatttatccttaccttaaaaatagtcatgaatctgaattttgtatatagtgttgaaggtgaatctgacattatagtttttagagttctcattcattatgctcgttattttttctcttgacaccccagcaagaatttaggaaacctttgctggagtgcccttgtgaagaaaggccttagtttgttacatgccaaagtaccatgtcctgctgacaagaagcgttctcctcctatacaaagagtgatacagtattcactcagagctcacagccctgcctgttccgcatgctgggatcctcggggactggtgcaagtgggtggaggaggttatataagctcacatctccttccaagtgggaagaggcgagggacaacagctgtcagctccacagctggtcttgccagcccaagtgattccaactttatttgatcagagaagaaggcttctcagtacacagaggggagatttgctgatccagagccaatgttttaaaactttggcaatttgtgctaacttcctctggctaggacagatgcttattggctctggctgcctggacatggtgttctcgaggcattttgtgtcatcctgaattgggcccagccagctgctcatctataggagattctcaaggaatggtgcaaagctcattacccttagacttttggttgggcagttgctcttgcatcagtatccatttcattacattaaactaaaagaataaaataagttctcaaaaggcagatataaaacacagcaatctccataggccatttttttatttttaattttttggggtacatagtaggtatatacatttatggagtacatgagatgttttgatacaggcatgcaatgcataataatcacatcagggtaaatggggtattcatcacctcaagcatttatcctttgtgttacaaacagtccaattatactctttattttaaaatgtataattaagttattattgactatattcactctgtattgctatccgatagtaggtcttattcattcgttctaattttttatactcatttaccatccccacctccccatcatccctccactacctttcccagcctctggtaagcatctttctataccctatgtccatgagttcaattgttttgatttttagatcccacaaataagtgagaacatgtgatgtttgtctttctgtgcctagcttatttcacttaatataatgatctccagttctatccatgttgttgcaagtgactagatctcattcttttttatggctgaataattactccactgtgtacacatactacattttctttatccattcatctgttgatggacatttaggttgcttccaaatcttagctattgtaaacagtgctgcaacaaacattggagtacagatatctctttgatacactgatttcctttctttggggtatgtacccagcagtgggattgctggatcttatagtagttcaatttttagttttgtaaggaacctccaaactgttctccatagtggttgtactaatttacatgcccaccaacagtgtacctcagttcccttttctccacatcctccctagcatttgttattgcctgtcttttggatataagccattttaactgggtgagatgatatctcattatagttttgatttgcattgctttgatcaatgatgttgagcatcttttcatatgcccgtttgccatttgtatgtctttttttttttgagaaatgtctattcaaatcttttgcccatttttggtccagttttcttttctgcttcaataggaaagcactgagttcaatgcatcacaattgctgtgttctccctcctccagcagccagagatgttctctgaaacatgctgctgctgccaggagttggcagggtggtggtgtctgcaattctggactgttttatctatctcctcagtgtcctttcggcgatatgaagttacaaccaggtactttgtactatgagtgcttacatgatttttggttctgatgaaggtatttttttctgtgtagatagttgttaacttggtgtcactgcagtggagggggacaatcggtggagccttctatttcgacatcttgctctgcatctttccacaataattggcaatttattcttttaaaattttgagatgagtggagtgcagtagcgtgatctcagctcattgcaacctcccacctcagccttcagagtagctggaaatacaggcacaccccaccatgcccagctaatttttgtgtgtttttttttttttttgtagagactgggttttgccatgttacccaggctggtctcaaactcctgggctcaagcaatcctcccgccttggcctcccaaagtgctgatattacaggcatgagccactgcgctccacctggcaatttattcttgatttactgtaactctgggaaggacatggctagcacataacttaatgtcaacatttctttttacaactgaaaggaatattgggcttttgggatgcatctcttgtccttggtggactataagggtgttgaaagccagttgtaatggcctgtcctctgtagattcccctcagaactaagtctatgcctgttacaagcttagttactatatttatagctagcacagataagaaatctatgtgatggaatattaaatttatgcctgacaagcaaaactatagtaaagagaaaatttgcctacggccttaaatactttggagacagacaaatttacaaggacagtatgtgaggtcggggttataatatgatcgtgtacacagagagagtacaggaaggactgcaaacaaagataggatatggggatattgaggaagacttagagaagacaccactgagaagatgatacatcttcttgtatggaatcttgaaggacgatttgaaattagccagtgaagtggagtgtgaggtacaaggatgctaagtggagggctcagcttgtacaaagaaagttttcaaagtacgcgttgccatctcatgagggatcatgtatatcctctcaaggtgagtatacttagtcctgtagttgatatggaacgctttgcagcaggggaatgtagtaaattttagatagtttaacccacctcttactggttttttgcattgggtaagatatttaatcttcctgaggtttagtttcttcatttgtaaaacagtactactaaagtttattatacagcaactttgatcattaaatgggggtcaaatatctagactatgcatagtatattagagctactcagaaaataacagattctcttctctttatactcatgtttgatttcctgtattacattatattttaatttagcaagtgtatcttgagcacccattttcgcctatttcaatgctaggccctagggatggagttgaataagataccgtccttgactttatggagctacaagttatgtaaactaactattctaaccacaagaccatggtttcttgtctcctctgtgccactgggcaaccatcgacccactcattttctagccttctgcaaaactcctctttatcctcacctatctttgcctttttatctctcatcccagaaaacatcctggcccttctcctgcccatagatgatctcttcatttgggttttttatcccactccttgtattttcttattttttctccctccatatagcaacacacttaaatccctcttgcattaaaaacagagccccattcttactgtcaaggcctggaaggactacagcataacagttttggctaaatgatgatagtcaacacattgtagcaataggaactcaagagttgacattattttaaaacggaggtatggtacctcaggatggttttttagcagggagcaaggtgcttagttcagtggtggtaggaaggggataatggcaagtgtcaaagttgtccataaccggccaggcacagtggctcacgcctgtaattcccgtactttgagaggccgaggtgggtggatcacctgagggcaggagtttgagaccagcctggccaacatggtgaaaccccgtctctactaaaaagacaaaaattagccaggcctggtggcattgcacctgtaattccagctactcgggaggctgaggcaggagaataacttgaacctgggaggcagaggttgtggtgagcggagattgcaccattgcactccagcctgggtgacaagagtgaaactccaactcaaaaattcataaataaataaataataaataaagattttccataaccaaatatgatccagttatagagggcatgactatcaatggagggtgtgattcacacaaaattcatctggcactcaagtggtatgcaaggtagagactgggaattctgaaccagatagaagtcctgatgtttcaaatgggacacaaagtcagagtcaggctggtagccacattgacatgacagtaaatctagtgtatggggctggagttcttaatctaccctgtctcattgtagacttggtctcagcaactagagccaaggtagacctatatgagcaaattaagtagactccactcttgaaagaagaaacgagtctgctaaatgccttactatttaaataaggaaatctttgagaaagtatgttttatatagaggaaatcatatgaacaaaaagcacagtatgaaaaagtgtggcatatttggggaacatatagtaatctggtgtgattagaatatacatgtttcatacaaggagtgcaagaggtgaaactggagagtagattggcgtgagactgcagggccttgaatacgaggctaaagagtttatacttggtactgagttaagtctactagtactgtcttatacctggtgtctgtgggatctcatttaggggtgtgctgtgtccttaaagcatttccttagtgcctttccttataaaatatatggtggtttcttcacaaggttatctacttctacattgggaatattgagagtcagaaggttaagatttttgtttaaggtaatgtaagtagtaaatggaaaatgcagaatttgaacgtggtttagtgccctttcctagtatataacctagtatattgtcgaggttagaagtaagggctttagagtcaattatgggtttgaatctccatttcttttacttctattagcttgtgcaactttggaacagttcgttttctgaggctcaggctcattcctcttctgtaaaattgggataagaatagtaacattcacaggcttgtatgaggattcaaagaggtaatgcatatcaagtgcttaacataacaacttacaaataatactcaataagtggtaactatttctagtattacattaaagttatattggaaaaatgtgtttttacttgaaaaagttaactcagaatatgtagaataaaaggagttgatccagtattctgatgttatagtcatatttggataggaattcatgcttgttctgcactgaggttgcaaatttgcttcatgtgttcattcactgattcactaaacagatgttaatttggccacactctgtacctgacaccattccttgtacaatgaacaggacagatgaagtctctgcttatgtagaccttacattttagtggtgtgccagagggtgggaggcagatgttaaacaaataattagataaataatttcagattgcaacaaatgcaataaatgctttgaagacaataaaatcggtgattcgatgttacttgtgggggtggagttggtctagggcaactttagaaggagtcataatggacagcctctgaaaatgtgacacttcaggtgtgacctgaacattgaaaagaagccagtcatgagaaaaattggagaaagagtgttctagtcatggcaagcgcacaaaggtcctgaggtaggaacaagcttagtggtttgtctaaggaactaaaagaaggccattgtgtctgaagtgaacactgatgagagagtgttctggcccaggccagatcataggggattttgtaggtcatagtaacaactatggattttatcccaagcacagtgtggagtcctggaagtttttaactgtggggaatgatatgatcaatttatatgtttttgataataataatagcttttgtttattggacagatacagtgataagcacattacatgcatatatttcatcagtcttcacataacccagtaaaatatgatgttatttttgtgattattttagagattaagaaatctgaagcttagtaaggttaattttttaaaggtcacaaaattattgttatttatagaaccaagatttgagtttgagtttatctgatcctaagcctacatggcttttattaagctaaaatatatataacaggccaggcatggtggcccacacctgtaatcccagcactttgggaggccaagacgggcggattactcgaggtcaggagtttgagacctgcctggccaacatggtgaaaccctgtctctaccaaaaatacaaaaattagctgggcgtgatggtgggtgcctgtaatcccagctactcaggaggctgaggcaagagaattgcttgaacctgggaggtggaggttgcagtgagctgagatcgtgccactgcactccagcctgggtgacagaacgagactccaggtcaaaataaatacataaataaaatacatataacaacattggctattttaatcattttaagtgtgtaattcagaaatattgattgtattaaaaatgatatgcaaccatcaccatcaaatatttccaaaacccttttatcaccccaagcagaaactctgtacccggtaaggaatgactccccattttccccagccctggtaaagtctaatttactttctgtcttctctatgaattttcttattctagccaagcttgctggctcatgactgtaatcctagcactttgggaggccgagatgggcagatcatgtgaggtcaggagtttgagacctcagccaacatggtaaaaccccgtctgcactaaaaatacaaaaattagccaggtgtggtggcacatgcctgtagtcctagctacgtgggaggctgaggcaggaaaatcacttgaacccaggaggcaaaggttgcagtgagccaagatcgcaccactgcactccaggctgggcaacacagtaagactccatcttaaaaaaaaaaagaattttcttattctagatatgtcatataaatgaattcatactatatttctctttttgtgtctgacctatttgaattagcataatgttttccaggttcattcatgttgtagcatgtatcagaagttccttcatttttatgggttaataatattccatctagtgtatataccacatattttttgtccatttatcaattgatagacatttgggttttttccaccttttggccattgtaaatactacagggaacattggtcaccaagtatctgcttgagtccctgttatctattattttgggtatatactttggagggaaattgcctggttatatggtaattctgtgtttaaatttttgagaacatgacaaaatatttacctgggtgcctgtaccattttactttcccatcagcagttcacaagagttccaatttcttcacatcctcaagaacacttattttccacatatataattttcatttctaatttttttatagacaggatctcagcctgtcacccaggctggagtgcagtggcatgataatagctcactgcagccttgcattcctgggctcaagagatcctcccgcctcagcttcctgactagctaggaatacaggcatgtgctactgcatccagcttttttttttttttttttttttgtagagatgggggtctcaccatgctggtctcaaactcctggcttcaagcgatccttctgctttagcctcccaaagctctgggattacaggctattttctgtattttttattttagatatcctaataactgtgaagtcatatttcattgtgattttgatttgcatttccaataactaatgatgttgagtatcttttcatgtattcgttggctatttctatatcttgtgatatggccatatgtctattcaagttttgctcatttattttcttattgttgagttttttctttttttgagatggagttttgctcttgttgcccagactggagtgcaatgacgcgatctcggctcactgcaacctccgcctcccaagttcaggtgattctcctgcctcagcctcccaggtagctgggattacaggcattcaccaccacacccagctaattttttgtatttttaatagagacagggtttcaccatgttggccgggctagtcttggactcctgacctcaggtgatctgactgcctcagcctcccaaagtcctgggattacaggtgtgagccaccgtgcccagcctcttattgttgagttttaagagttcattttatgttttgcatactagacctttgtcaaatatatatgcataattgtgtataattttatataaatgtgatcatatagcgttctgttttgtaactttttttaatactcactaatatcatggatacccctgtaggtcaataaatgttctcttacaatttgtaatgactcataatgttccattacataaatgaattataatttagtttgtttttatttctttgttccactttgctattattaataatggtatagcaaacattttcgtgaaacatgaactgaagcagatagaacagcaatttcattggaactttttaacatttgcctttctgaaactgataataattgcccaggaaaaataagtgacaatatcaaaatcttaacaatacaataagtttgagctattttatttacatagaatacacagaactttgtatccaagaaacagggatacatgttcttttgggtacacagacaacattaagaaatataaactatgcatcaggctataaaggaagcctcaaaaattcaaaagattctatatcacatagagtatgttttctaaccataagaaaataaaattaaaaattaatgataaaacattccatatttgggaactaacaaaatggcaaatattctttgggttaaaaaaataaatatattttatgatgaaatgacaatgaagtcagtatatatccacatttgtgggacacagttcattatgtagaaaggaagttcattgctttagatatattgatcaacaaataagaaagattaaaaacaaatgtattgagcatttaaattaaaaaaattgataacaacaacaaaacctacccgaagtgacaaaacagctggacatataagacttaagggcagaagtgaaataaattaaaaaacaactataacaataaaaaatggtagaggtaattaacaaagccaaaaattagttattgaaaggattaacaaggtagactggtaggaaaatgcaaacaaacacagtagagaatatagagtaaaataaatgaaatattacagacacaacagatttgttaaaaagacgaaagaattataacacatttgaaaaaaaagagatgaggttaattcctagaaaaatgtaaatggccaaaagttggcaaaaggaaagagggagactgagtagacggatatatattaaagatattgaaatggaattcatacttcccctccccttcactccctcagaaaaagtggtccccaaaaattttaaccttagaaatgagtcggttcaaatcctttcattactagtgtaaaggagaaaaacatgtgcttattgtaatcaaattagaattgcaggaaaattaagtaaataatatttatatgataacctatagcaaacattatactaaatggagaaactttaaatatgttcatcttacgatggagaacaagagaaagatacccatttgtctactattgtttaacccagtactggagagccccactaatactgttagaatgaaaattggccgggcgcagtggctcatgccgataatcccaacactttgggaggccgaggcgagcagatcacctgaggtcaggagtttgagatctgcctggccaacatggcaaaaacccatctccactaaaaatacaaaaaattagccagacatggtggctggtgcctgtagttccagctacttgggaggctgaggcaggagaattgcttgaacccgggaggcagaggttgcagtgagccgagattgcgccactgcactccagcctgggagtgagactccttctaaagaaaaaaaaaaaaaatagaaaaggaaagaaaattaaataagtgcacaaagatgggaaggaaagatttaaaattggttactatttgaaaaacattacaaaacagcatggtgttatttgcagatgatataattatataactgggaaaatcagcagcatcagtaaactttataaggactaataagaaattcaccagattggcaatgacacgagtaatttgccaaagttaatattatttttaatacgtgcaataagtaaccagtaaatgtgataagtaatattgatacgggaggggggcaggcaagtgctaggaagagaaaggcccggtccctggctagggctccacccctgggcctgtgcccacggacctaggtgaggacaggcatttctgttttcatgccaaaatgttgcattttccaagaccaccctggcccgccatgcccccatcctttgcctataaaaaccccaagaccctagagggcagagacacaagtggttggacatcgagaggaacacacaggcggaagaacacagccgcagacaccagcagataccaggaggacaccggcagacaccaggaggacaccggcagacaccaggaggacaccggcagacaccagcagttgccagcaggtcatctatggcgggaagacgctgagttcagccgagggcggtcagaggagaggcaggagagctcggcggctgagcggcctgactcctggggaaaaccaacttcccactccatcctccttctggctccccatccatctgctgagagctatttccatcattcagtaaaaccttgcactcattctccaatcccatgtatgatctgatttttccggtacaccacggcaagaacccgggatacagaaagccctctctccttgtgataaggcagagggtctaatttagctgattaacacgagctgcctatagacaacaaaactaaaagagcacactgtaacgcacgcccactggggcttaaggagctgtaagcatttgcccctagatgctgccttggggttaaagcccacatgccccacaacctgcccatctgcatgcgccccctagaggtttgagcagaggggcaccgaagaagcgagccacagcccagtctcatgccctgtgaaggggataagggaacttttcccgtttcaatatcattcacattagcaataacaactaaaatatgcagaaattattttcaaaagaaatacacaagatctctattgggaaaaacattaaaatctagtaaaggacatggaagaaaatataaataaattctagacctttcctcttttcaaatggatttcgttaatattatacagatgttaattctcctctaattaatctataaattaaagtttagttgggtttttagcttaatatgcacaaatagctaagttaaccttaaaaaaaaaaagacaaaagaagggagattttctctaccaggcagcacacatattacaaagtcagtggagtgaaaacagtcggatattggtcctcaaacagaaggctagtcaaacagaatagatagctgaagttcaaactcacatattaatttaatataaaataaaaatcgcactccaaattaatggggagtggaaaaattcataggtgattataggaataatgaatctctatatagagaaatataaagctggattcctacgtaacatcacaaacaatgctgaattccaggcggatgaagggcctagaagtgaaaggcaaaactcaaaggttgtttctgtcctgtgtatatacccttttctgataaatatatggaacaaactaggaattcaagggaacttcttcaacctgattgatggcagctgtaaccaaaactagaagttaacatcacacataagggaaagactaaaatcttttcctctatggtaaagaacaaaataaggatgtctacgttcttcactttgattcaacattgcactggaggttctagttagcataattagccaaaattggaaagaagtaaatctatctctatttgcagatgacttcatgttgtatatagaaaatcctaaggaacacacacacacaaacacatacacacacacacagaactaatgaaggagttcaacaacattgtgtaggatacaagatcagtatataaaaataaattttatttctatctactttggaataaaattgtatgtctattgacattaataatgtgaacattaagaaaacaatctgatttaatcaaaatgattaaaatacttaggtataaatttaacaaaagatgtgcaagacttatatgctgaaaactacaaaacatcattgaaagaaattaaagaagccctaaatcaatagaaagacaagctgtgttcatgaattgaaagccttaatattgttaagatggcattactcatcaagttgatctacagattcaatgcaagccctatcagaattccagctggccatttcacacaaattggtaagatgatcctaatatccacatagaaatggaaaggaccagaatagaaaaaaatgtcaaaggcaaatttttaaatttcaaaacttactacaggccgggcgttgtggctcacgcctgtaattccaacactttgggaggctgaggtgggtggattacctgaggtcaggagttcgagaccagcctggtcaacatggtgaaaccccgtgtctactaaaaatacaaaattagctgggtgtagtggcacatgcctgtaatctcagttacttgggagggtgaggcaggagaatctcttgaacccagcaggtggaggttgctgtgagccgagatcgcactgctgcactccagcctgggcaacaagagtgaaactccatctcaaaacaaaacaaaagaaaacttactacaaagccacagtaatcaagatagtgtggtgctgacataaagatagacatatagatcaatagaataaagagtccagaaacaaacatttatggttcactaataatttacaaggatattaaaagcaatcagttgggaaagaatactcttttgaataaatggtgctgggactaccggatatttacttgcaaaagaataaaggaaacatagtacatccatacagccaaataatattcagtcataaaaaggagtggagtaccgatacatgctacaatatggatgacccttggaaacattatgtaagtttaagaagccagtcaccaaaggccataatgcagattccagttaatatgaaagatgtagaataggaaaatccatagagatgaatgtagactgtggctttttgaaggtgggtggaagggggaatggaaaatgattactaatgtgattaagatttctttttggggtgatgaaaatattttggaattagataacagcagtggttgcacagctttgtgaatatgctaaaaaccactgaattgtacactttaaaaggatgagttttatgatatgagaattatatttcagtttttaatttaaaaattgaatttgaaggagaaagtattccacagaatcttatcggtccttggtgaaggcagtaaggttttctggcccatgcttttctcaaataattggtactttaaattgattcaacagctggaggaacagtttgtccttcctatgttttgtgtgaaaatgtctacctcctgtgttttggtatctgagttagggttgggctatggaacttctcgagttgtattcctaagacgtcttgattatttataagccccatgaatgttattccacccatgataatctgggctacatggactgtgatcttggatgttagttcagcttatttgaaccttaatttcctttacaatatctgcttctcagtgttgtaaagtctaaatgagataatagactttaagtgtctatcatagtgcctggcctgatgtaggccttggttaatgaatgttagcttcctccctacacgtttcccttcattaaaaaaaaatagtaaaaagcacatttctttctttcttccctgtccaccccgcctgaaacagagtcttgctctctcacctaggctggaatgcagtggcacaatctcggctcactgtaacctccacctcccaggttcaagcaattctcctgcctcagcctcccaagtagctgggattacaggcgtgcaccaccaagcccagctaattttttttctcttttttttttttttgtatttttagtagagatggggtttcaccatgttggctaggctggtctcgaactcctgacctcaggtgatccgcccgcctcggcctcccaaagtgctggcattacaggcatgagccactgtgcccggccaaaagcacatttcttatatgtcacaggtcactcagctctgccctagcttcctgcccagcaacagattgcttgtagcaataaaccatgggtgatttttttttctttgatccgtgtgtcccctgctgtgcctcttctactacctggcacattgcaggtgctcagtgattttggatttcgcatgagacagcacaagccatttacattgattttccagcatgatgctaagagaatagtagagtgtcagcattagtctgtgacaaaggaacattgttagtgctactttagatgctgtgtttcttccagttgtgctgagtagcagagaacttaattaaatttcatactcgagaagagtaaaggctgagtccttcatctgccacaaatctttacaacccttgctttctagttaaactttccaggattttttttctctgtttttaatatcagctttttggagtgaagtgcttaaataataccaagtaatttattaaaaagagacaatcccaggttcctatttctttggaaatgttttacttattattagctgtctaagtgcattgtagattaaccttttcatgacaaatatttacttccatttgtgttatgtcttcttcctttgtaagaaaatttgaatgagtggttaatctatgtgaaaaatattggagggaagaaaatatatctactgcacaggcccttttaaggtatcattctctaaggagcagcttccatagctttcagctgtaaaaatagggactgccatttctgcaggcagaatggtttggggttatatttcaggaagctgaaactgctgagaccaatacaaagttaattctccgttgcttttttttccttccaggagctagagggattgaccacctgaaacctgacactatctccttcattctcctttctaagcagacagagttacaactacagacatttaatctttgcccttctttcccacctttaggagcggaaaaagaaatttgaaaaggatggtgagaggttttattctttactggatcggcacttacacctgtcttcaaaaaagaaagaatctcagttacaagaggtatgttcacaaagcctgcccctgccttccattgctagctatgccttagaaacagtgtgaattttgtactgcaaggcttttcccataccccgtctcagcagggaacctcatgtgatagtagcacttgtagtcaaaactgtggcctgagactcagaagccctgaatactaagccagctcttccactaactcagggtgtgaccttggataggatacttctttctttgcctcattccattatctgtaagaagaggagtcgagagtccctttcaattgcaagtccaaaatccatgcgaggataaagttaaactagtgttgtatttggtagaaatcaggaacagatcttctacttttttccctgagagattccacaacctttttttttttttttttttttggtgaggggttaggggaatgttctgttttgggactactgcttacctgggacttgcagtgccttcagttcaaataagctaccattcggtgagaccctaccacatgccatgaactgtactggatgcaacatggctacagaaacaatgagacatgattcctgcccttctgcagcttactgttgggctactaaataagaaaacacattactcttatacaaatagattttttttacatactttaatgtgtatatggtgcttttgttgggagtgggaaatgagaatagaagacttatgtttggatgtggggaatttcctttgtggaagaatgttgcccttccaatttgacgtggtcattaaaatataggtaaagtgtttgacaggtgaaaatggataaatggacctttcaaacagagaccaatggcccaaggatggaaggaacataagtagaattctattttaggaatctcaaactggcataggttgtagggtgaattagatcagggagagactagaagcaggataaacagtttaggaaactattgatctaggaaacgatctaggggaaagtgacagagccgtaagagaggcactagggaaggaaaagaaggaataaactgattgagaatttttctaatggaaggaggggtctatatgttcaatgaaagattcagtaataatggagattttaaagattcaagtatgaaaagagatatctgatggaataatatcataggcaggagctgtcatcttgtccatggtcacacagattgtggcagagctggagctcatctcctgataactggtttcatagatatccatcacatcatctgaggtgcttgaaggtaataggtcaagagcctcagtgtggccgagtgcagtggctcatgcctgtaatcccagcattttgggcggccaaggcaggtggatctcttgaggtcaagagtttgcaaccagcctggccaacatggcaaaaccccagctctactaaaaatacaaaattaaccgggcatagtggcacatgtctgtaatctcaattacttaggagactgaggaagaagaatcgcttgaacccgggaggcggaggttgcagtgagctgagatcactccattgcactccagcctgggtgacaagaacgaaactctgtctcaaaaaaaaaaaaaaaagccttagttgtggatggagttagtattgcaaaggagaaggactactttccttccataaactagaattgagtctgggatcttctatcattttccttttgcccacttttgtttttttccttttctatctattctgtgtcgcggtttctatgcagaaaacagtcaacaggcctgagactgctatgcttagaaagacctgtttacaaaattagcccttggaatggcatctgggaacttcactgttaaacagctcccaacattgatttagaagtttcccttaatgggtaagaatggctgactgtgccaagcctggctctgcaaataatgtagcttatgtcgaacacctttttcttctggtactcttgaattttggttgtgctgggcagagtgtgcctgtgtaactagccccgcagtaaaaccctaagctactcattctcttatgagcttccctgactgataacattttctctgtgttgttacaacttgttgaaggaagaattaaatgtgtcttgggtgacaccaccgtgagagatcttttggaagcttttacctagcttcctctgcattttgccccaggcaccttttctctttgctcagtcggctgtgtacgctttcactgaaataaatcttagctgtgagtactactatgttgagtactttgagtcctgctcaaaaaagatttattaaagaattattaaaattggggtggtcttctggaccctggacacaatccaaactattggagacttttgctaggacaccttctggagtgttctaggtgtttggtgctatatctagatgtccttttattacttattcaataaaaaaatgagcagggcaatcttgagttagtcactttcaaaaaatttagatttcatctttagagaagttttaggtttacagaaaattaaatagtaagtacagagttctcatatgcccttactccctcacacagtttctcatttcctcttttaggatcatcttgcatttgtgtgatacatttgttagaattgaggagccaatgtattaaacattctatgggttttgaaaaacatatgataacatatatccagcattaccatattgtacaggacagtttcgctgccttgaacatccctggactttatccctccctccttctacctctacctctgacaccactgatctttttatggactccatacttttgccttttccaaaatgtcatatagttggtatcatatggtttgtaaccttttttgattggcttcttgtagttagcaagatgcatttaaggtttctccatatcttttcttgacttgataactcacttctttttagggctgaataatatgccattgtctggttgtaccacggttggtttatccatttgcctattgaaggacttcttggtttcttctgaattttggcagttattaaagctgcgataaaaaattgtgtgcaggcttttagggatatacattttgatgttgtttgagtcaataccaaataatacaactgctatcatatggtaagattttatctagtgtcgtaagaaactgccaaactgtcttccaaattgactgtagcagtttttatttccatgaacaatgaatgatagctccggttgctccacatccttgtcactattctgcgttgtaccattaaaagtaatggcagaaatcacagttccttttgcaccaacctaatatgtacatggaatatctttccatttattttgacctttgatttttttcatcagtgttttgtagttctcctcttaaatatcttgtctttttgtgcctggcttatttgacttaacaaaataactttcagttccatccatgttgttgcaaatgacgggatctcatttttttcattcttttatttctgatgccacttctttgtgtatttactctcttacttatttaatgtggctaaaatattaacaattttattgatttttttcaaagaaccagctttttggttttgttgatttcctgttgttaatttcgttgatatcttcatcttcttttttttattatactttaaattataaggtacatgtgcacaacgtgcaggtttgttacatatgtagacatgtgccatgttggtgtgctgcacccattaactcatcatttacattaggtctatctcctaatgctatcccacccccctccccccaccccacgtcaagctccagtgtgtgatgttccccaccctgtatccaagtattctcattgttcaattcccacctatgagtgaaaacatgtagtatttggttttctgtccttgcgatagtttgctcagaatgatggtttccagcttcatccatgtccctacaaaggacatgaactcatcattttttatagctgcatagtattccatggtgtatgtatgccacattttcttaatccagtctatcattgatggatatttgggttggttccaaatctctgctattgtgaatagtgccacaataagcatatgtgtgcatgtgtctttatagcagcatgatttataatcctttggatatatacccagtaatgggatggctgggtcaaatagtatttctagttctagatccttgaggaatcaccacactgccttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgacgatgagcattttttcctgtgtctgttgactgcataaatgtcttcttttgagaagcatctgttcatattctttgcccactttttgatggggttgtttgattttttcttgtaaatttgtttaagttctttgtagattctggatattcgccctttgtcagatgggtagattgtaaaaattttctctcattctgtaggttgcctgtgcactctgacagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccttcttgaattaatttttgtataaggtgtaaggaagggatccagtttcagctttctacatatggctagccagttttcccagcaccatttattaaaaagggaatcgtttccccattgcttgtttttgtcaggtttctcaaagatcagatggttgtagatgtgtagtattatttctgagggatctattctgttccattggtctatatatctgttttggtaccagtaccatgctgttttggttactgtagccttgtagtatagtttgaaatcaggtagcatgatgcctccagctttgctcttttggcttaggattgtcttggcaatgtgggctcttttttggttccatatgaactttaaagtagttttttccaactctgtgaagaaagtcattggtagcttgatggagatggcattgaatctataaattaccttgagcagtatggccattttcacgatattgattcttcctatccatgtgcatggaatgtacttccatttctttgtgtcctcttttattttgttgagcagtggtttgtagttctccttgaagaggtccttcacatcccttgtaagttggattgctaggtattttcttctctttgaagccattgtgaatgggagttcactcatgatttggctctctgtttgtctgttattggtgtataggaatgcttgtgacttttgcacattgattttgtatcctgagactttgctgaagttgcttatcagtttaaggagatttggggctgagatgatggggttttctaaatattcaatcatgtcatctgcaaacagggacaatttgacttcctcatttcctaattgaataccctttatttctttctcctgcttgattgccctggccagaacttccaacactatgttgaataggagtggtgagagagggcatccctgtcttgtgccagttttcaaagggaatgcttccagtttttgcccattcagtgagatattggctgtgggtttgccataaatagctcttattattttgagatacatcctatcaatacctagtttgtttagagtttttagcatgaatggctgttgaattttgtcataggccttttctgcatctattgagataatcatgtggtttttgtctttggttctgtttatatgctggattacatttattgatttgtgtatgttgaacgagccttgcagcccagggatgaagccaacttgatcgtggtggataagctttttgatgtgctgctggattcagtttgccagtattttattgaggatttttacattgatgttcatcagggatattggtctaaaattctcttttttttttgttgtgtctctgccaggctttggtatcaggatgatgctggcttcataaaatgagttagggaggattccctctttttctatggattggaatagtttcagaaggaatggtaccagctcctccttgtacctctggtagaatttggctgtgaatccatctggtcctggactttttttggttggtaggctattaattattgcctcaatttcagagcctgttattagtctattcagggattcaacttcttcctggtttagtcttgggagggttcatgtgtccaggaatttatcatttcttctagattttctagtttatttgtgtagaggtgtttatggtattctctgatggtagcttatatttctgtgtgaaaggtggtgatatcccctttatcattttttattgcaactatttgattcttctctcttttcttctttattagtcttgctagcagtctatcaattctgctgatcttttcaaaaaaccatctcctggattcattgattttttgaaggtttttttttgtgtctcttatctccttcagttctgctctgatcttagttatttcttcccttctgctagcttttgaatgtgtttgctcttgcttctctagttcttttaattgtgatgttagggtgtcaattttagatctttcctgctttctcttgtgggcatttagtgctataaatttccctctacacactgctctaactgtgtcccagagattctggtatgttttgtcttgttctcgttggtttcaaagaacatctttatttttgccttcatttcgttatatacccagtagtcattcaggagcagattgttcagtttccatgtagttgagcggttttgagtgagtttcttaatcctgagttctagtttgattgcactgtggtctgagagacagtttgttataatttctgttcttttacatgtgctgaggactgctttacttccaactatatggtcaatttttaataagtgcgatgtggtgctgagaacaatgtatattctgttgatttggggtggagagttctgtagatgtctattaggtccgcttggtgcagagctgagttcagttcctggatctccttgttaactttctgtctcgttgatctgtttaatgttgacagtggggtgtcaaagtctcccgttattattttgtgggagtctaggtctctttctcggtctctaaggacttgctttatgaatctgtgtgctcctgtattgggtgcatatatatttaggatagttagctcttcttgttgaattgattcctttaccattatgtaatggccttctttgtctcttttgatctttgttggtttaaaatctgttttatcagagcctaggattgcaacccatgcctttttttgttttccatttgcttggtagatcttcctccatccctttattttgagcctgtgtgtgtctctgcacgtgagatgggtctcctgaatacagcacactgatgggtctcctgaatacagcacaatgatgggacttgactctttatccaactttccagtctgtgtcttttaattggagcatttagcccatttacatttaaggttaatattgttatgtgtgaatttgatcctgtgattatgatgttcgctggttattttgctcgttagttgatgcagtttcttcctagccttgatggtctttacaatttggcatgtctttgcagtggctggtactggttgttcctttccatgtttagtgcttcctttaggagctcttgtaaggcaggactggtagtgacagaatctctcagcatttgcttgtctgtaaagtattttatttcgcctttacttatgaagcttagtttggctagttatgaaattctgggttgaaaattcttttcattaagaaagttgaatattggcccctactctcttctggcttgtagagtttctgccgagaaatcagctgttagtctgatgggcttccctttgtgggtaacctgacctttctctctggctgcccttaacattttttccttcatttcaactttggtgaatctgacaattatgtgtcttggagttgctcttctcaagcagtatctttgtggcattctctgtatttcctgaatgtgaatgttggcctgccttgctagattggggaagttctcctggataatatcctgcagagtgttttccaacttggttccattctcgccgtcactttcaggtacacaaatcaggcgtagatttggtcttttcccatagtcccatatttcttggaggctttgctcgtttctttttattcttttttctctaaacttctcttctcacttcatttcattcatttcatcttccatcactgataccgtttcttccatttgatcgaatcggctactgaagcttgtgcatgtgtcatgtagttctcatgccttggttttcagctgcatcaggtcatttaaggtcttctctatgctgtttattctagttagccattcgtcttatcttttttcaaggtttttagcttctttgcgttgggtttgagcatcctcctttagcttggagaagtttgttattaccgatcatctgaagccttcttctctcaactcatcaaagtcattctccatgcagctttcttccattgctggtgaggagctacgttcctttggaggagaagaggtgctctgatttttagaattttcagcttttctgctctggtttctccccatctttgtggttttatctacctttggtctttgatgatggtgacgcacagatggggttttggtgtggatgtcctttctgtttgttagttttccttctaacagtcaggaccatcagctgcaggtctgttggagtttgctagaggtccactgcagatcctgtttgcctgggtatcaccagcagagtctgcagaacagcaaatattgcagaatggcaaatgttgctgcccgatccgtcctctggaagcttcatctcagaggggcacccagctgtatgagttgtcagttggcccctactgggaggtttctcccagttaggctactcaggggtcagggacccacttaaggaggcagtctgtccgttctcagatctcaaactccgtgctgggagaaccactactctcttgaaagctgtgagacagggacatttaagtctgcagaggtttctgctgccttttgttcagctatgccctgcccccagaggtggagtctacagaggcaggcaggtctccttgagctgtggtgggctccacccaattcgagcttcccagctgctttgtttacctactcaagcctcagtaatggcggacgaccctcccccagcctcgctgctgccttgcagttcgctctcagactgctgtgcttgcagtaagagaggctccgtgagcttgggaccctctgcaccatgcatggtatataatctcctggtgtgccatttgctaagaccgttggaaaagcgcagtattagggtgggagtgtcccgattttccaggtactgtctgtcacagcttcccttggccaggaaagggaattccgcaaccccttgcgcttccagggtgaggcgatgccctgccctgcttcggctgacactctgtgggctgcacccactgtccaacaagccgcagtgagatgaactcagtagctcagttagaaatgcagaaatcacccatcttctgtgtcgctcacactgggagctgtagactggagctgttcctattcagccatcttggaaccttcagtcgatatcttctttaatgtttattttttcttattttctgcttactttggatgtgatttattcttctatttctagtttcctaagaaggaagcttacattattaataagagatctttcttctattctattatatgcatttcattctataaatatttctctaagcactgcttttgttgcccacaaatattaaattgtgttttcatttttatttaattcaaaatgtcttaacatttcttattttattttatttattttttgtagaattgaggtcttaccatgttgcccaggcgagtttcaaactccaggtttcaagtgatcttcccgccttgccctcctaaattgctgagattacaggtgtttgccatgatgcccagccttacttttctttgcgtctttgactcaggtttcatttataaatgtactgtttaatctccaattatttggggcattttcagcttttaaaaattgatttctggtataatttaattgtggtctaattgtatatttcataagatttctattcttttagatttcttcaggtgtattttatgtcccagaatgtggtctatcttggtgatttttctgtgtgactttgagatgaaagtgtattctgctgttgtatcaagtgttacaaagatgtcagttagattcagttgatcaatggtgctgttcaggtcaacaatgtccatacggattttctgctagctggatctgtccattactattagaggagtattgaagtctccaactctaatagtaggtgtgtctctccttgtaattctctcaatttttacctcatgtattttgatgctgtgttgttaggcacattcacattaagaattgttatgtcttcttagagtcttgccatctttattattatattatgatttgatatcataatatttttccttggtagttttctttgttctgaagtatgctttttatgaaattaatatagctactctagcattcttttgattaatgttagcatgatatatctttctttatacctttacttttaatctgtctttgttttctttacattttaattgttatttcaataggtttaggggtataagtgttttttggttacatggatgaattgtatagtggtgaagtctgggcttttagtgtacctgtcacccgaatagtgtacattataccgaacaatgggtaatttttcagccccctctcaccaccctttttctgagtctccaatgtccattataccactctgcatgtctctgcatactcagagcttagctcccactaataaatgggaatgtgaggtatttgatttgagttagttcacttggaataatggcctccagttccagtttctgtaaaagacattattttgttctgtttcatggctgagtagtattccattgtgtgtgagtgtgtgtgtgcacacatatatacctactatattttctttatccactaatcagttgatgggcacttagattgatttcctgtctttgcaattgtgaattgtgtgaagataaacataggagtgcaggtgtcttttctgatgtaatgacttcttttcctttaggtagattctcagtagtgagatcttggatcaaatagtagttctacttttagttatttgagagatctctatactgttttccatagagactgtatgaatttacattcctacccaaagtgaataagcattcccttttaaccacatctgcatcttttgttttttgactttttaataatggcctttctgagtggagtaaggtggtatctcattgtggttttaatttccattttctttttttttctttttatttatttttatttattttttctattatactttaagttttagggtacatgtgcacattgtgcaggttagttacatatgtatacatgtgccatggctggcgctgcacccactaactcatcatctagcattaggtatatctgccgatgctatccctcccccctccccccaccccacaacagtccccagagtgtgatactcctcttcctgtgtccatgtgatctcattgttcaattcccacctatgagtgagaatatgaggtgtttgcttttttgttcttgcgatagtttactgagaatgatgatttccaatttcatccatgtccctacaaaggacatgaactcacattttttatggctgcatactattccatagtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcccctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgaggagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgtttgctctgatggtagtttcttttgctgtgcagaagctctttagtttaattagatcccatttgtcaattttgtcttttgttgccattgcttttggtgttttagacatgaagtccttgcccatgcctatgtcctgaatggtaatacctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatcgttccccatttcttgtttttgtcaggtttgtcaaagatcagatagttgtaggtatgcggcattatttctgagggctctgttctgttccattggtctatctctctgttttggtaccagtaccatgctgttttggttactgtagctttgtagtatagtttgaagtcaggtagcgtgatgcctccagctttgttcttttggcttaggattgacttggcgatgcgggctcttttttggttccatatgaactttaaagtagttttttccaattctgtgaagaaagtcattgggagattgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgaaacagtggggttttctagatatacaatcatgtcgtctgcaaacagggacaatttaacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcctctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgccaggctttggtatcagaatgatgctggcctcatgaaatgagttagggaggattccctctttttctattgattggaatagtttcagaaggaatagtaccagttcctccttgtacctctggtagaattcggctgtgaatccatctggtcctggactctttttggttgctaagctattgattattgccacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttacttttctatttcttttaattgtgatgttagggtgacaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttatgtacccagtagtcattcaggagcaagttgttcagtttccatgtagttgagtggttttgagtgagattcgtaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtacagagctgagttcaattcctgagtatccttgttgactttctgtctctttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccgttatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgagaattcttttctttaagaatgttgaatattggcccccactctcttctggcttgtagggtttctgccgaaagatccgctgttagtctgatgggcttccctttgagggtaacccgacctttctctctggttgcccttaacattttttccttcatttcaactttggtgaatctgacaattatgtgtcttggagtcgctcttttcaaggagtatctttgtggcgttctctgtatttcctgaatctgaacgttggcctgccttgctagattggggaatttctcttggataatatcctgcagagtgttttccaacttggttccattctccccatccctttcaggtacaccaatcagacatagatttggtcttttcccatagtcccatatttcttggaggctttgctcatttctttttattcttttttctctaaacttcccttctcacttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcatctgaagccttcttctctcagctcgtcaaagtcattctccatccagctttgttccgttgctggtgaggaactgtgttcctttggaggaggagaggcgctctgctttttagagtttccggtttttctgttctgttttttccccatctttgtggttttatctacttttggtgtttgatgatggtgatgtacagatgggtttttggtgtggatgtcctttctgtttgttagttttccttctaacagagaggaccctcagctgcaggtctgttggagtaccctgccgtgtgaggtgtcagtatgtccctgctggggggtgcctcccagttaggctgcttgggggtcaggggtcagggacccacttgaggaggcagtctgcccgttctcagatctccagctgcatgctgggagaaccactgccctcttcaaagctgtcagacagggacatttaagtctgcagaggttactgctgtctttttgtttgtctgtgccctgcccccagagatgaagcctacagaggcaggcaggcctccttgagctgtggtgggctccacccagttcgagcttcctggctgctttgtttacctatgcaagcctgggcaatggcgggcgcccctcccccagcctcgctgccgccttgcagtttgatctcagactgctgtgctagcaatcagcgagactgcgtgggcgtaggatcctccgagccaggtgcgggatataatctcgtggtgctccgttttttaagcccgtcggaaaagcgcagtattcgggtgggagtgacccgattttccaggtgccatccgtcacccctttctttgactcagaaagggaactcgctgaccccttgcgcttcccaagtgaggcaatgtctcgccctgcttcggctcgcgcacggtgcgcgcacccactgacctccgcccaatgtctggcactccctagtgagatgaacccggtatgtcagatggaaatgcagaagtcacccgtcttctgcgtcgctcacgctgggagctgtagaccggagctgttcctattcggccatcttggctcctccccaatttctattttcttgatgattagtgatgttgagcattttttcatgttattggccatttgtgcatcttcttttgaaaaatgtctgttcatgtcgtttgcccacttttaaatgggatttttttttcttgctgatttgttggagttccttgtagattctggacactagccctttgtcagctgtacagtttgtgaatattttctcccattctgtaagttgcctatttactctgttgattatttatcttgttgtgcagaaagattttagtttaattaagtctcatttatttatttttgtttctgttgcatttgctttaggtgtcttagtaatttttttttattaggccaattcctagaagcatttttctgtgttttagtctagaagttttatggtttcaggtctaacatttttgtgtatcttatttaaaatgatatcttttaggtaacatagttggctcttaatttttgtgcactatgacagtctatcttttaatttttttagatcactgacgtttaaaagggtcatagataatggtgtaatagtatctactatattgtttaccatcttctacttattgtttttgtttttatttttgtctttcagtcttcttttgacttctcttttttaagagaatattttatatgatcttattttctgtcttctcttaccatgtaaattatacttcttctttttcattttttaatggttgccttagagcttgcaatatgcatttgtggttagtttatgtccacttttcaaattccagtaacgtagttatgggttgtacaggatcaacagactatttccaatttctccatttagtcccttataatggtactatcattctttttacttatttgtaagatacaatcaccaaatgtatcattacaattattattatagacaaattcttatctgttaggtccattaagaatttgaaaaataaaatatttaatcttcatttatttcttttctagtgctctttttttctttctttttaggtctatatttccgacatatcatttttcttctactggagatcttttgtcctttcttgcaagacaagtttagtggtgacaaagtgctttaatttttgtttgtttgaggaagtctttattttaccatcacttttgaaggataatttcacagtttacacattgttaagtagttaactttttttctttcaacaccttcaaatattttatagcactcttttctttctgcatggtttcttaagagaagtctgatataactctttatccttgccctgctgtatagtaagttgtttgtttttctctctagcttctttcaagattttctcttgtattttattttctgcagctttgaatatcatatacctacatggggattgtttggtatttatcctgattggtatttattagtatttattatattattgtatttattggtatttatcctgagctttctggatgtgggtttgatacctgtcttttattttggaaaattctcagtcattattgcttgaagtatttcttctgtttctgtctctttttcttctcctattggtactctgaaaatacgtatattaacatcttttgtaattgttcaccagttcctgaatattctactccatgtttgtcattctttttttctctttgcatttcagtttcccacattttttttgacatgtatttaagcttactggttctttcctcactcttgttcaatctactggtgaaccctttaaaagtagtcttcatttctgctacagtgtttttgatttctagtgttttctctgtatactctcttgcagttttcatctgcctgctactattacccatctgttcttaggtgctgtctgttttttatattagagcccttatcatattaattataattattttaaatttagttttatgtttcttttttgtttgtttctgagatggagtctcgctctgtcacccaggctggagtgcagtggcacgatctcggctcactgcagtcttcacctcccaggttcaagtgagcctcgtgcctcagcttctggagtagctgggactacaggagtacagcaccacacttggctagtttttgtatttttagtagagatagggtttctccatgttggccaagctggtcttgaactcctgacctcaggtgatctacccacctcggcctcccaaagtgctgggattacaggtgtgagctaccgcacttggcctacagtcttatatttctacaatgtctgccttacctacatttgattctgatgctccttttttctcttcagactgtgtttattgccttttaatatgccttgtagttcattgttgaaagctagcggtgatgttcagatgaaaggaactgagtgaaacaggtctttaatgtgaggttttgtgttgaactggctaggagctaggctgtgcttagtttgctgtagctgtcattgtctgactctaaaattttctctggcatcattgtttatgtgctcagattttaccatttcttgttaaataagacttgagacttgcagttctttctgttgtaatcccctcagtattggccatagtagcatgcttctgttcttgggctttggcccttgttaatttcttattctctgtattcatgtctctgtagtgtttgagggagcagattttcctctgacttcagttctctgttgaatataataaaatgtgtggattttacacttgttcagcttttttctttttgtcagggtggatgtaatgacttcaagctttttatgtgttggaccagaaactggaatcctgtatcagtcacttttttatctcttggctttaggttctctatttctaaaataaaaggtaacatcactagttggtggctaaatgctcatctagctctagcattctgttcaatccttaagtactgactttcatgaatgaatatcccaatatgtaatgtttgttttccttcttctacaggcagacctacaggtggacaaggagaggcacaattttttcgagtcctctcttgattatgtttatcaaatccaggaagttcaggagtccaagaagttcaatattgtggagcctgtaagttttctctgttgatgaatggtctaaaaatatttatcaaatgcctggtaaatgtacaaactttgatcataaaaacagaatcccaaagaacgtgaaggataatcagtggaaatgtctagaacgtagtctaacttacgtttttcttgttctttagtatactttttttctctctttccccccaacccttttctctctttttctatggctattttctttctctttcctttttttcctttctctttcctccccccttccggaatttctctacaactcttcctgttactttgtttccctcccttccttcttcttgcgctttcagaagcttctgaaagtctttctcatataccagatactatgctagggactcatgtctcttgcagtcagtgacttctcattctactacttttacttctgtcttgtgtagttttttcccatttcacgttttttcattccatttacttcgttttgtgtagatttttccatttccatatatttgtttgagacagggtctcactgtcacccaaactggagtgcagtggtgctatctacaacctctgtctcctgggctcaagtgatcctcccacctcagcctcctgagtaactgggactacaggtgcatgcctccataccgagctaatattttgtatgtttttgtagagataaggtttcaccatgttgcccaggctggtctccaactcccgggcccaagtgatccccctgccttggcttcccaaagtgccaggattacaggcatgagctaccatacccagcccgtgtatttgatttttaatggggttgaaaatttacaccaatatatgttgtgtatcatttatatgtctttttctgcaaccctgtgaaacatttctaattttaaagttggtttagactcctttgatcttttagcattatgacagtcttcattaaagttaggtagaaaatcttgctttattcatttatctatttactttcattcattcaagaaatatttattgagcacctattgtttgtggttgctgaggatatatagaggaaagatgcagttcatttacatactgttcaaatgatgaatgtctttatatgagatctgaacaagctcagggttaataaatttgttaatagttctttttttctgaagctgagtcaagggtaaatgttcaacctgatatgaaaacagtgatgtgtagactggtttgtgtttgactgcgtttagcgctatactgggtaaacaccatggagttttttgttgttgttgtttgtttgtttgttttttgtttttttgagacagtctcactctgtcccaggctagagtgcagtgatgcaatcttggctcactgcaacctccgcctcccgggttcaagccattctcctgcctcagcctcccaagtagctgggattacaggcgtgcgccaccacggccagctaatttttgtatttttagtagagatgggatttcaccatgttggtcaggctggtctcaaactcctgacctcacgatctgcccgcctcggcctcccaaagtgcagggattacaggcataagccaccacacccagccacaccatggagttttttggtgagttcatgtttcttttatttagtttattagaagatgctggtgataaagttatttttacatgttttccctaggtcttggcctttcttcatagtctgttcatttctaacagcctgactgtggagctcacacaggatttcctcccatacaaacaacagctccaactcagtttacagaatgtgagtttgcatgtggatttttctcaccggtctttccattccgattgaatttcagccctagcgaccttgattcttggaattctaggttactgcatcctagccaatttgttagaatatactggtgtggatcacaaatatttagtatatcagactgttcttgctcttccactttcacatctttcctgtttttgaggctgactgctgttcaaacccacccttccacacaccaacaccttcatctatgcaatatttattaagtattgctaatttgctgcatctctctcagatcaggacatagctataggcttatttgagcccaggccttaagctacttccctgctcagtcaaaacactctcactgtagactttattaccacaaacactcattttatcttctctttcttttctcagtacttattagtagagtcacataaattacttttaaaggttttctctaccttctttgtcatgctggttcttacagatgggcatgtaggcatagtgttcccatccttttcacatatattcctttacatgttcctttattcaacccacattaaacaaatgtttatggaaaaaatgaacataagctctgtgccaggcatgtgaaaggcactggacatgccatgaagatgcatgcaagtttttctgtcttgaaggaacatacagtttcttgtaggagacaaataaacagagataaattataatccattatgataagtgctataatagaatcaaggccaaaggtttttaaaaagttcagagcatttggctacctggtagagtcagagaaggcattactgagttggtgactttagaatgggtgttaaattgcatgaaatatatagatgtagttttagatgaaaaatgctggtaagttatagtgaaaaataagccccccttggttgtttaggaggattgggatttacagttgttgttattattttttctttctatatactctccttgcagaaaggaactaggggctctcacattctccagaatttcctgatttacaacatcttcctactacaaccaagttaatcccatgaatcttcctctatatattacttgatatgtacaaatgtaacaataagcctttgaatgtgtacatatgggtgacttatttacaggataaacatgagccaactagatgggcagcacagatcacctttctcactaacatcatgtcataattttaagactgggtactaaaaacttatctgtagtgattttcatacccacatttcaacacatgtcttaccattgtgttttagttgtgtagatttaaatagatttattctcatcattaggttttggtatttgtgagtatgaaaacatagctactgttggcccttctcccaagagagcaccctctcgtatattttatgttcttggccagaatttgattcagtatcaactaggctgtaactttgagacacaatttggaagttgctatgagaatgctacctttgggaaccttgtctgccatctcccttgttgtaaagcagggtatcagtcatgttcagaattctaagattgcttatttattagggccttatgtgattcgtattagtaaaaagcctcccagttgttattttatgagtatattgctcgttatatttttgtttcctatgcagtctttaggaccgttagactctataaacttgttttccattcactatgccattcaccatttctttttttgctttgtggttgcacatgctgtaagcagggaaaactttgtactgagtctctgaccaagaaatactttttcatgataatgatgatgataataatgattttcatgatgatgtcttgacagacaagaaatcatttctccagtacccgggaagagatggaagaacttaagaaaaggatgaaagaagctccccagacatgcaaacttccaggacagccaactattgaaggctatctctatacacaagagaaatgtgtgtggggacataggggtatccattgggtttcaataagccaggaactactgccacttgtcggctgtgaattttgggcacccttactgttcatagacccctgatagctaaaattcccttggaacgcaggcagggaatactgaaaacaaaaaaaaaaaaaggagaaactgagaggaagttaaagatttgtcttacaaaggctgtgtagtgataagacctaaggttttctctgagattcaaaatgggtattatttgttctttaatccttctgattattcttttggaaaaaagggaagtagaggaaaggaagtagaaaaataatatttcttatacttattatgtaccagacatggtgctaagttcatttaaaacactgcctcatttaatctttgcaaccaatttatacccatacacataaggccactaaggctcagagacgtcaccatttgaaagtcacccaactaacaagtgtcaggactaaaattaaattcaggtctatgaaatgccaaagcccatgatcctactatagtaccctatatcttcgtctgcattagggtcatatgtttgctcttttcttttctttttttaagacaggatcttgctctgttgtccaggttggagtgcaatggcaccatcatagctcactacagcctcatactcctgggctcaagcagccctcctacctcagcctcctgagtggctgcacctaaaggcacctaccactacacttggctaagttttgaattttttgtagagacaaggtctcactatgttgctcaggctcatggatgctcttatagcacttagtgaacatcatgattccagtgggaaagacagtatctgtttttcattggtgactaagtaaagtgggttaacttgtttagtcactgaatgttgcagagcattcaatctttcctaattcctcagtaacattatgcacacctgtatgtgtgatttgattttatttgccctttgaactatgacccaatactccccaaacctgttattcagtttttgcccagagttattatatctggggaataaacagaggacacacacccagaggctgccagtagcaaaaatcactgtaattcaaaaagcatgacactacggtagtgaaattatcacacttttctttgcatagagcagtttacttgtgatgattttcaaagatgtgttctcccacttgtcaggttcatctcttcaactgtgtgtcgcacaatttctcgatctcagtgctgttgacatttcaggctggataatttttagttctgggaagtggtcctgtgtattatagtatatttagaagcatccctggcctcctcactttgtgctcatagtaatctccaggtgtgacaacctaaaatgtctctaatgtattgccacatgtcccctgggaggccaaattacccctagttgagaaccactgctgtatgctgtgtgatccttctgtgcttcagtattctgatttgtcatatgggcataacattgctactcagttgaatgtatgcttaatgagcactgtttctgccagatactgtgcaatgcattggggacacccttgaaaaactgaatcaaccatgatttctttcaccaagaagtgtaaagtgatgggagagatagacaagtatatcaataattataatgaaatgtggtgataactgtatttggggcatatatctaaaggcttcacaaagaaagtgatatttgaactagaacttgaatgatgagtgggagtttgataggtaaagaaaaggaggaatggccgggcacagtggctcatgcctgtaatcccagcactttgggaggctgagacggcagatcactggaggtcaggagtttgagaccagcctggccaacatggtgaaaccccgtctctactaaaaatacaaaaattagctggatgtggtgatgcttgcctgtaatcctagctacttgggaggctgaggcaggggaatgacttgaacctgggaggtggagattttactcagccgagatggtgccattacactccagcctgggtgacagagtgagactctgtctcaaaaatgaataaaagaaagaaagaaagaatgaaagaaagaaaagaaaagaaagaaaggaaagaaaaaggaaagaaagaaaggaaagaaaggaaagaaagaaagagagagaaagaaagaaggaaaaggaggaagggaattccaggtatataccactgcatgagtaaaggcagggttgtggatagacatagttgatttgtagggcccttgtttgccaagaatagtcctgctttacccctgttgtcctgatgtaattattaataatactgcctcattcagtcttaaataagtcttggatttggactagaaattatatggctacctctttatgtgggaactaaaagtaattcattgagacaggaacatagaggtgaggtgccaaaagaaaaagctagaaaggtaagttttgatcatgttatcaagggcattgtaggcaggctaaggagtgtggagatagtgggaaagccgtggatggtttttaatgaggggaatgataaaaatagagatatattttaaaaataatctaggaaaagagtggagaatgaattggagtggagtgatcagagatggggacaatagggaaatcagagaaggccaatgaaataattaattggtgagatagtaaatttttgttttttaaaaatatgtttcataaaatataaatacaaaataagacactgggcccagcgctgtggctcatgcctgtaatcccagcactttgggaggctgaggcatgcagatcacgaggtcaggagatcaagaccatcctggctaacatggtgaaaccccatctctactaaaaaaaatacaaaaagttagccgggcgtggtggtgggtgcctgtagtcccagctacttgggaggctgaggcaggagaatggtgtgaactggggaggtggagcttgcagtgagctgagattgcgccactgcactccagcctgggtgacagaacgagactctgtcaaaaaaaaaaaaaaaattaaaacaaaaacaacactgatagggttcttaactaattcggtgttaaaaaggaatggagaggaggagacagttaaaagagagatgtgtagagtcatgtacaggttagaaggggcataacccaatgaccaatgacatggaacagttatagagacagcaaagtaaatgacaatagtctccagcttctgggatatatggtgatacaatttatagggaacatggcagggagagtaggttttgagcaagccagaagcagctgtgggaagcagttggtgaaggttagaatctccctgtgtgcagtaggtaggtggctatggaaggagggcggtcagggcaagggcagggctggatctgaagtttgactctgaagagcaatgtgtaaatagcttccatcttagggttgacttcctatacagctaaaatagttattctgtctgctcacttttacttgtccttgtaggggctttaggaatatcctgggtgaaatactattgccagtatgagaaagagaccaaaacactgaccatgacgcctatggagcagaagccaggtgctaagcaggtcagttcttgtttgcaccatatttttggaaatggatctatgactgtttctcagaaaagaatatatgttgacctagtatcaaatcatcaagttcatcactgttacgtgaggccatgactttatatgtacaccttggcctaagtttgagtcagatagcactgagttgagtgaaaaatttctctgttgattagagcaagccttttgaaagtgccggtagtctttcaaaccagttatttttacaagtgccagtcacattgtacagtcaactatgtaaaaatatggatgaattacttttaagaatgctctactcttggattctttaaaatagcaagttttaaaaatatgaattgaattccaaaattccttttttacaggagtgtgtttatggcccacagttggaataaccgatactcacattctatgtactactcaaatatctttaagcagttaatctctctttttctgccctccaaaccttctctcactcctgaaaatgacaagataaatttaacacactgaaaaaaatagtttacttacctggaagaacctgatcttttacaaacacacacacacacacacacacacacacacactcacacacactcacacacacagatacacacatgggggttccttaagataaaagctgatctttagacagattgtttatattctaaaagtagttcaatgtgcctctttcccctttaactggctctcagacagggtcttagtgcatgatttttaagcatttgcactctttacaaattgtttgttggaagtgcttcaagggttatttgttagcactgaaagtagtacatgaagacccaatttaggtagggaggaatttggagaaaaattgggacagtttctctcccttgctgatccttttcatggaagatctctcttgtgtggcttgctcatgttgaattagagaggatggaaatgtgctttcaggctactgaaatttttttggagtgagagtggtcttttaaccacaagatttagctccctgctttaatgtgctttggtgatgggatggacttgtaaaagatgttgtatcaaacagagtttctggaatcctcggctatgctttattattattgttattattattattattatttgcgatggagcttcactcttgtcgcccaggctggagtgcaatggcacaatctcggctcacagcaacctccacctcccgggttcaagcgattctcctgcctcagcctcttgagcagctggtattacaggtgtgcaccaccacacccagctaatttttgtatttttagtagagatggagtttcaccatgttggctaggctgatctcgaattcccgacctcaggtgatcctcccgccttggcctcccaaattgctgggattacacgtgtgagccacggtgccagttactgtgcttttatcatgggccagttactcattcaaaaccctcctcagtttccagtccgccagttgccaaagcacctttcagtgtggttccaataaattcatcctgtgttttagcactgatttgttccaagtcagtcagaacttagctgattaatctgactaggaagtgcttataagcaacactggcctgcagtctctttcttttatttttctacacacattacttttcaaataccggagaggaaagctccttttgtaggcagtaatttcatttaggcactttctctgaggctgctcagaggtgcttattgcaaactccaagacagagtcagcagataccactttcatatcctcctgacagatgccagcaagccctccttttagtttttctttccctcttctcttttcattgagtagctgcttgcaaaactgcaatggtggtggcctgagcatttttgatgtggtattccttatggaatggaaagaagaacttagttactcacaaggcagagggaggtggtgggggttacttggatttccccaaattggagttggaagtgatttcttcctgtcagttctctgtttcacttcttaatactagtttgtattttacaattataaattttacaaataaatgataccataataataagaacactacaaaagccactatttcttgaatacctgctgtgtgccggacactgagctagacccttctgtcatattcatgctcctcatttaccctcctagcagctatgtgaagtcagtgcccccaatttgtgtaggaagtgagaccaagttgaagatgcaggaattggccatctttctgactatggcacttactatagcgttggtcccactactttagcctgtcagctctcatctgtgttttcatggtcaattttctgatcatcttctcaaatgataatttattagatcttcatcccttccctgttaggaatttgtggtcagaagaaggagtactgcattctgaatcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgcagaataagtaagagtttagtcagacaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaggtccctgagctgcaatgtcattgaagctgaggacattgagaatttaaagagatagagtgagtctgtgactttgctcataactctcattttgaaagactaatgtgtgacatcccacatttaggggtaggaaggcatactgaaggattaatttagagttgagttgttatagtgcaggagcaaggaaagattggcctgcaagtggctgagtatgctgatgagcaagaagtattgggtaatgagccacgtgggccagtttgtatgtcatagtatctaggcacctgggcagtgttacctaacttgagataccacagtgggttttgttattcccatttaatagattgtgaagttaagacttagagatggaatatgatttatttatttatttatttttgagacagaatctcactttgtcacccaggctggagtgcagtggcacgatcttggcgcactgcagcctctgcctcccggtttcaagcgattctcctgcctcagcctcccaagtagctgggattacaggcgcccaccactgtgcctaatttttgtatttttagtagagacggggttttgccatgttgaccaggctggtctccaactcctgacctcaggtgatccacctgccttggcctcccaaagtgctgggattacaggcatgacctgctgtgttttggccagggtcacatagctggtaaatggcataactgagacaagaccctaggtcttaaactttctagtgtgttgctatttccactataccaatttggatgactttgggtatgctgctttacttctttaagtgtcacttctctataatggttgttaacaataaaagtggcttaaaaatacctagcataggctggacacagtggctcacgcctgtaatcccagcactttgggaggctgaggtgggtggatcacgaggtcaggagttcgagaccaccctgaccaacatggtgaaatcccgtctctactaaaaatacaaaaattagccgggcatggtgcgcacctgtaatcccagctactcaggaggctgaggcaggagaatcgcttgaacccgggaggcggaggttgcagtgagctgatatcgcactactgtattctagtctgagtgacagagcaagactacgtctcaaaaaaaaaaaaatgtagcgtaatatatggcacatagtaagtgataaatgttacttctctttcctgtatcacatggtctctgttgagataagagagggaatctgaacaaggtgagactagaattttagtctgtggacacagtgggttttaattcccttaattacctacaggactaaagtgggccacactgtccttgctgcacatatgaaatatcaaatgctaccatgactaatacacacatttgctatttcctctacttttgcgctacctttggagcgattacatttgtgatttctgtcatcctaaagagtctagagttgggagacagaaatgtttttctccctccttcatctgccactttaatggaagcttctttgctcagctaccctctgactttctaagggaggttttagacagccacttaccccgtcacaatttccctccccagaggcctcatgaaaattttattctgtacacttaatgccattcagtcagcccatttctcctacactccccttacatgatatgtattgagcttcctattaagtcttccgtcttgggaaagagtgctggatgactctgaacaatttctcctggtctcagccattgattcttggagcggggagaaaccatctgccatcttgctgcaaatactgtttgaagggacaagattctcagtgagtctacacattgctcctgctgccttgaccagacgccttccaagtgacactgaagacactgtaggaagcagaaacagcttctgtgtctttttttaaaaattgcctgttaattcttgtttcatatcaggggcccttggacttaacactgaagtactgtgtgagaaggaagacggagtctatcgacaagaggttctgttttgacatagaaactaatgaaaggtaagctgtgccgctgtgaattggcaatgtccccacgtgccagatgcttagcctgggtaggtcttttattttcctccgtcatcccacgttgatgacaatgagtaagtctattcaggactttgttgtgagtctattcaagccagctcttctggctgcccttcccagggatccctgctagacctggcccagtgctgcttttctctgtgcaagcttctatcagctttgcctcacttgctctgggaagaaaaagtctctcctgggatttaatttgctatcagatgtgcaaaaggtcaacatttggtgatcttgcaagaaggaaaggataacaaagctcattctttgttaaatctcctaatatcacataaaagaacaaatgaattggcacacatttttgagggagggaagatggggtggagggtcgtggtgttattagaaagtcatttccccccatttggtgcaaaaatgatgcagaccttccctactttacagatactcaatgaactggaaatagtgtgattatcacctttcagatcttacagctaaggcttgcacattttggacttcgttgtgtttgtttctccccagtgccctctttttttacttgaacctgagcagttttatcagaggagaattttaaccattaaaatttcaaatgaatgcatttggcattattgtggagaaagacatgctttatagttgggtggttgtaccaaaataaacagaataaatctgtttctagattttatctcaaccttttatttctagatgttagatacttagtaatagaatagaattttgcaaaatgatcagattgctagaaaggaacttgaagggtgaattacaatatcatgtgaacaaaactagcagtgactgggatcataacaatcagactaaatgatgagggcatttttaaaaaaattggggaataaaggacttagcttgtttcattatttcaaaattgagagattattatttgaccctcacaatttcgatttgtgaatttatatcatttctttgttaaaaatggatgatcccaattgaggtggctctgaaagtacgtattgttgccagtaaccatgagactgtcactcattttcctgatagcctcagttccagtaggaaggggaaaattattgttggctgtggcttcccttttttgcaaataatatccccaactcaagcagttgcaaacagtttgtccccgtggttaggggctaggatgaatttatgtttcttgtacctggtgctatgcatggctcatgataagtactaaatttgatgtttatttttaagtgtttttttcttatcctagaatgctgaagaattttcgacactagaacccagggattaaagttttgatgcatctacacttttagttatcatatactgtgcactttacaaaacattccctcatttaatctacaccccccccattttaccagtgaggaaactgagacccacatatatttaactgacttgcccaactaaagtcacataggaaatggtgaggctgagctcaaaccctggtctgtaggtctccaaagcccatgctggtttctttttgtttgttttgagatggtgtctctctctcttgcccaggctggagtgcagtgttgcacaacctctacctcctgggctcaaacgagtctcctgcctcagcctcctgagtagctgggactacaggcgtgtgccaccatgtccagctaatttttgtatttttaatagaaatggggtttcaccatgttggccaggcttgacttgaactcctggcctcaagacatccacctgcctcggcctcccagagtgctgggattataggcgtgagccactatgcctggctccatgctgtttttaattttttatattgtctattataagcagaagaaacaagctgcaaagtagagcgttaaatataataatgaacaggtgctgaggcccctctctgcatgtggagtcttttgagtgacatgacatctgcttttctggctagtcagtctgatataaggaacagagtcaggcttcctagcaggcatcaggcagctgtactcacattccctggagcacagagcaaagggctcttggagccactttttctatgtcaggaagagaggataagattttttatttttttaacttttaattttttagagagagggtcttactctgttgcccaggttggtttgcagtggcacaggttcaagtgatcctcttgcgtgagcctcctgagtagctgggactgacaggtgtgcaccaccatatctggctaattttttattttttatagctatgggaccttgctatgttgcccaggctggtcttcaactcctggcttgcagtgattctcctgtgccagcctcccaaagtgctcatattacaggtgtgagtcactgcacctggttctaaatttaggctcttagcagtatttaaaatgacaggctcatagcaaggcagagcttgaaatgttttaataacagcaacaacaataattgtaataataataaaaacaattgctaacatttgccaagtacctcctttgtgacaggcactgttatcagccatttaagcgtataatttcctttagtcgtcaccacagtcacatgagggaggtgatgttatttgaattttggtttgtgaatctgtatcatttttgtgttaacaatggatgaccccattcaagatggctgtggaagtatatattgttgccagtaaccacaagactgtcattaagaggtgctttaatgaagtaagagaaggtaggacaggaaccccatgattccagcaggtagaacaggattcctgtgatatcagtaatggaaaggacctcccagctcctgtgttccagaaccctttcagataaagaaactgaggtctagaaaggcctagttacttatccagggtggctgaactctcttggcattgcttttatcattctatgactctaggagaggtctcatcttatcacagaatttgtggaaggaacaatgttttcctaatggctcagcaagccaggagaatgcaaggagactttataccttgcataaagtatggttaatctcaaaattccagatgagtcacaaagatctaaaaagaccataaagagcataacagcttgggatatctctgggtagttagtagtgtcttagtccatttgtgatgttatgacaaaatacctgagactcagtaatgtataaacaacagaaattcatttgtcacatttctagaagctggaagtccaagcagtttcagtgtctggtgagggcctggtctctgtttccaagatggcatcttgttgcagtgccctccagagagcaccaacaccgtgtcctcatatgtcagaagagatggaagggaatgaacctactctttcaagtttttgtaaaagggccctaatcccattcatgaggttctacccttatgactaactcacctcctaaaggtcccatttcttaatatcatcacattggtagttaactttcaacctatgaattttggggaatattcagaccacagcaggtagcctgcaaataaatagaataaaacagggttcgaagccgtgtgccaggcagaagaggccttatattgtagtaatgaagaatatggctgctggaccagactttctggatttaattcctgtctctagtagttccctgctatatgaccttggataattactctgtgcctcagtttccccttctgtgaaatagagatgattactgtaactgccttattatatatattaactgagttaatatacatagtttacttggaacaaaatttgtcacctagtaagcattcagtaaatattagttgtttttattagtcataaaattgcttattagccaaaacgcctcctccctgtgtcttagccagtactcatgttgttgaatttattgcaactcaaaatgtttcttggacatcgcaggtgctggaagaagcaaagccattttactgagagataatgtgcctctgatgttcatgctcattcctagagctcagacaaagtggctggcttccaacagagtaaggcagtgagagcctttgtttggttcaagcacaatggggccaatttaagtgtgcattatggaggcgtcttgacagttaccttcctatttcttgcaggatctgggcacaaggccaccaagataccacccccgcctccatggttcccaaagttactgttctgtaaattgcctattgttttcttgagtaaaagagattttgaaaaattagtattctgtaagcctatgcttgttcagtgtgacaaactccagggcagagagggaccctagatcacaagactccattctctcagttgaattttctgctttatacttaccatttttttccccctcaggccaggaaccatcactctgcaggccctttcagaagctaacagaaggctatggatggaagccatggatgggaaagaacctgtaagttacctgacactggggaaacctccccagcatatgccagtgtatgagtgccctctagtggtatcagtgggtctcagacaattaaatggtaatggattgtttagtctcagttttagagctgtaaggaattgtttccacatctcttagcaggtaaggcaactggagttccagaaaggttgagggacttttctgagaccaccctcagagaagacaccaaaaccgggcttagaatgcagatctctcagctccctgctctagtgttagactatgtagctatgcccatgagcttttcttcagaaagaatgaagccatttttcaggttataaaatcaatatgtgttaattaattaatatgtgttaatatgaaaaataattgccatagttataaataagcacttattaaacatttattcagaatgatttttctgcctcacccttataccaccaactcagcttattctctttgagggtacagctggtagcggagatggcattgccatcctgtatcacaagatgtaccgttccatttagaacacggttatgcaggaggacaagcaatcccttgaaagggttactgattatcatcaagcgaccaatagaaacagttggaaataattgaaaaacattctggtttcttagtggcatattaaataatatcagcttcctggtgttggaattccaaaagcttggatataggtactagttctgccattaaatggctatgtgactctgggcaaatcatttcacctctctgagattcagttttcttctcctcagtaaaagggctttaataatttctttctacctatctcacagggttgcttagaaaaaacagatggaagtcatcttgtaaaccacaatgtgctagccgatctgaatgatgggatacaaaactcctaagatccagcagtgttcagatacagtcttatttctttgctgtattcaagtgaaaaactggctaggagggaaaatgcattctaggtttttctttctatgtgtcctcagtatcctggagaatttagaggggtaactagatcccagattgcacttatagtaaactggaaggtagcaggagagacttggtattctgaagactgccatccagaaaatattccagcactgtcttccttctgtcaccttccagaaacctgctgctgaactctttcatgcttgtgacatttctgtaggcagatgctgggaagctcagcaaggcatttatctttcaattccctctcccaagtttgctctccctttaggttttcaagaatcaaaggatgcagatggctttctgtggagaatgatgtgagcacatgggcccactgaatgtggatccataccaacttgatcatggcagatttttccacaaatcccttgtttagaaaagtagcagaaaaggctggctggcacaaaaatatctcccactgaaatatctgtgggcatacacacatatgcagaacttattttaaggagaggctgttcaaacagactcttaacagatggcatatagagggctcatttcctgcaacctcacattactaatgttgttgctcctttactaaacactccagttcactagtcttacaaatctcatccatgcctttgcctaaactgtcaaagaagatcagggcttgaaggaatgtctactccaaccctgatcactttactgatataaattttgagatctggagaatggaaagggcatgcccaaaatttcctaagaggtagaggtagagccaggactagacttcaagagtcaacagtcttctttctggtctctcacatagctatcacagcacatactccaagacaacacagacaaatcttggtgtattcatggatctctttcagatggacatttgcctttccacagagaagtattcatcaaccagtctttgagggtgggagattggtgttaggaacatttaaattttataatgcccattagacaggtacatagccatgaggaaaacactttcctggtctcttgctttatcataaaaatgccccaggtgttacataagtaaatatctaagatggattagctaaaactgtagctatggtgaactgtgtgaaattcagtgtaattttcagggattgttcaagtattttctttctttcttccttccttccttccttccttccttccttccttccttccttccttccttccttccttcctttctttctctctctctctttctttctttcttttttttttgacagagtctcgctctgttgcccaggttggagtgcagtggtgtgatctcagctcactgcagcctccacctcctgggttcaagagattctcctgactcaacctcccaaacagctgggattacaggtgcacgccaccatgcctggctaatttttggatttttgtagagatggggtttcatgatgtttgccaggctggtcttaaactcctgacctcaagtgatctgcctgccttggcctcccaaattgctgggattacaggcatgagccaccacgcctggcctgttcaagtattttctagcaatcttggcaaagcaattatgtttagcccacttggctatctttttaacatcctggagtttctaatcatttttaatgcctatctggggaaagatatttaatattatgttctctgttttcctatattgattgacaatagccatggatctttctgtttatcttcttttgtagatctaccacagccctataacaaaacagcaagaaagtgagtcacttaagtttttggtctactagcattataaactgccagctgtccgattcatagtaaataccatcattaatgatgtgtactactaacgcaagtctgaatatggatgcctttgtgtgaaataaaattcagccatatattttttaaatgtgtctggtaattgaactaaggtagacacttggtgttagcttacatcgtgggtagagaaacatatccttcctgttctggaagcatgatagaaattgtatttttaggctaacatttcacatatgactttgctcatgctgaaagcagacaattcaaagggctaaatataagtattttgtgttataagagttaaaatgttaaacctcccctgaaaaaatgactctttccatttaagggtgactagaaatgagcaactaaaaacccttagctctctcaatgcagtccctttgcatggtcattaaatgtttaataggtgacacctgttgcagcaggatctaactcttttcctttgcttgaaacagtggagctaaatgaagtgggcttcaagtttgtcaggaagtgcatcaatattattgagaccaaaggtaagatctgaaccatagtcttggcattgtctgaatctcgtcactctgattttatcctgggcaatttctctgaagtagcgttttaggaatgaagactgtttataaagcttgtgtagtagatgcaagctagaaaatttcagaaaattctaaactagtggtatgcaagcatatttggataatttggattcctgcttttaaagagcttataagtttataaagtattctcaaacagtacctggcactccttaagcagtgtcatgatggttctatcctaaatgatcaagagttcaatttctgccacagtacatactggtatgaaaattgatggggcagagccaaactcagggagatgtggaatcagcattcttcctggttgccgatactccctggtttccttctgaggatatttagactgtgggcaagtgtggtatgtgaatcaagtctctttgttctttgaaatgtttttttagtctttcttggtgcaggaaatggccttttgtttcacagctgccttactccagccctctcgtgatttatatcactgcttagaagcaacttgagggttgatccttcctcctttttcaattgaatgaacttctttctaagatggcagcaccattctcagctttctgctgccgcccaaactaagcatatgcttctatttactatagagtttgttttcttctcttcagattaatgagggtttggtacactccaaatgaaaggatggataatttggagagatgctgtaggactattcccctgttacagggaaggctggagaacttggagtatgtagtgtgaccccttcctatctgaattgaccctagtgtaccaaggggagatgacaactctagctatacaagtgaaattaacctgattttttcctccactagggatcaagacagaagggttgtaccgcactgtgggcagcaatattcaggttcagaagctgctgaatgccttttttggtaacaattttactttgataattcttattgggagtactttatgtgttacaaagaaatgtgactggaagagaaaggagacactgctaaaatgtggtagaatagttgaaaaaagtattttctaaagtaaaacatacacatacttgcccaccctgggcagagtcaatcgtaccttgaaaatggctgttatctctccttcctcgtatcccattcactccagaaaccctcagcaatacaacttctttccctacatctcaactggaactgtgtggccaggcttagtcggtatcttcttaccaaatccagtgaatacttttgagtttgtgtcttacttgatctccttgttgaccactttctcttttttgaaactttctccttacatgacttcgtgacttccataacacatcagcactcttctgattcttctcacatcttttttttttttttttgagacagggtctagctctgtcgcctaggctggagtgcagtggcatgatcatggctcactgcatcctcaacctgagcctcctgggtagctgggactataggcgtgtgccactacaccaggctgatttttaatttttttgtagtgatggggtctcactatattgcctaggctggtcttgaacttctggccttcaatcatcctcttgcctttgcctcccaaagtgctgggattacaggcatgagccacaatgcctgacctcttctaacatcttataggattccttttcaataacttgctgaacctttatctttctgttttttacaccttgactgtgtgtttcctacagttctatctttgttcttggtttacttctttttttttaatatgtttttctattgattgatttttttttattctggttatggctcacatttttgtttcttaaaaaacatttcttgtaatctttattggttgctggatgttgtgacttactgaatgtcttgattttgttgatttcttttaaagaggactgaattttgttttgtgggcagttatttgtggatcaatttgatttatttgagtcttctttttaagctttgttgggccagatataaagtatccacccccaggtaaggttgttgagctctttttccacatagctcactcttctctggtactgtgccttgctagttatagctgcttcaaccttcctaaactttgatccttatctcttcagctgagcaagacttccatgctcagcttgagttcccactccatctgctgcaatctaaaaagtgcttttaagaagcaagctgtggagaaggtagcagttatcttgtttgtatccctcttctcagagtcatagtcctgttttgtctgttgctcaataactacatgcaggagtttcctatatactgtccagttttctagttgttacagcaggaaggcaagtctgataccagttagtccaccatggctggcagtggtattctctctttatgctttttactagcacctctatgctgacaactcacaaaatctctgttccagacatcatctgatgagttctaaatgcaaatattcacttgcccactgcacttgtgcttctcagtcatattaaggtcatggcacatatcagaatgatcatctttatatagcatgctcgggtaaatggacatcactgaggcaagaagccctaaaggctgagggagtcaatattggagtctctgcacaagctctctttacatagatggttcacaggtatctacctgcatttctctccctgcaaacctacccttcttcctttcgtgggtggcagtgaagcatcttgtaagctgagttttcacagtgtcagagaacaaattgagtgtggaaaactgcagtttggataaaatacatattttttggtccttactgtgatgcatagctaatctctcacaagcctgcaggtctgacaaccaaccctactcacatttgaggatgttacagcactcagtcatagcaggtgtggtttttgaattccagattacatcattagtacctcatcatctgttttcattaatcaccttacattcttgacttttaaaaatttggattgcttattcctggtcaatttgcaacccatctcattagctaaggacactttttcatatgtaaatcagctgacatcgtggtccagcatattgaatctctgaaaaattattgaactcagatatttattcagataactattgaactattgaaaattctgtttccagtatcactcttatatctgttgtataataagctaaaaaatgccatgccaggcatcccactgattctcttatgggctttaataggactgaagtggctccttcaaatcacacacggcagtagaatttgattcaagtattaaggaaagtggtagagttggtgtatttcatttattcaaaaccatcctccaaatattaactctcataggaatatctaaaatatagaccaggaagttctagatataaatattgatagatgcaatataaaactgttaacttccttatttgtatatgaaagtggcaaccccgatccctgccccaaatgtatgaaactccagatgtggtgatgatcctcattcatttattcattgagcaaatatttgtgtgcctacccgggcatcaatcattgtgtttagggcagtggattgaaaagtgaacatattccctgtgttttccacctttgtggggcttacattctactgggaaactgtctctcagttacctttcaatgtctagttatgtggggagaccttccttctaagtttatttcatgtgatgtcctctggcgtgtctcactgggatcctcaaagctgtcttgcttcttttcaccctttcctgatctagtctcataccactaggggcttgttgccttggctgcatgtggacccatcatgatttatcctggagggtgaacatccattgccttttggttacgtaacatctctccctctttttttttttcttatgtctcatgctctgtgctagtcaaaaggatacttcttgttatttttttttacctaaacaaccctcagacttctttccctatgacatctcctataacttgtaactgtaggctttcttctatcgtttactaaagccttttcttcttcccctagacaaaagtttgtctttttgggaaataaaatatatcacagagtataaagtcaaaggcaatacattcataatcaatagttattttcaatcacgctgttggttggttggtcacattccttgcctacaccagatttttgtatgatgctttatgttaataggttttatgtgaggattagaatcttcactggtgctggatccattgtaagccaccttggcacagagaagccaatctgattatctcagggacaacttggaacctcgtgtaagagttctgtttcagaaggggaacatcacacactggggcctgttgtggggttgggggaggtgggagggatagcattaggagatatacctaatgtaaatgatgagttaatgggtgcagcacaccaagatggcacatgtatacatatgtaacaaacctgcacgttgtgcacatgtaccctagaacttaaagtataaaaaaaaaattaaaaaaaagtttaaatcataaaaaaagagttctgtttctctttcctttatcaagctataactatcttattaatgaaaatgccccccattgtcgttatagtcttaataatcatgttgtgctccagagactcttaagtatttcacaatggagcagatgggtgagatggggcatggacagcaatgagactggttgtatcagcaggggctcttgatagagttgagcctggttggcagccataaacaggaaagtgttgttctcacaatccccttaccatgccagaggcctatggatctaaacagaagaggacctgctgtaacgagtgaagtaacaagtcacttgtaagatgttatttatgttattttcatttcctgtttagatatttaaatttcttatttcatcattatggcattagaataagatacgtggacttctcagaaactaagtggaatacctaatatatatagacagataatagagtaggaatatgcatacagtcatttttccattttcataattaatgtgaattattcagcatctggagacttaactttagcattaaattcacatatattcggacaaatagataataaatacattaatcagaaatactttcaagttatgtgacctctttgtttgaatgagaaattcagagtcccctagcaaataaaacaaaaatataccacactccacttcaggagttgcagaacttgaactctatatgttaatctttaaagcaactgtatatgttaaccgtttttctgatactgtcgtatgatgtgatctttagctttccatacatatcaagatactttattcataaagccagatccttgtatatgtgtgtatatgtatacatgtatgtcataaatagattttatataggttcattaatcattactatacttactactttaaatacattgattattctcaaatcatgcttgctttgaaatagtaccactagagtttgaagtaatttatcaatggatatttactgttaccctttccaaattatttcctatttgcatttgactatgaaactgagttcaaaaacttttagaaataaagtttgtgatatgaatatttgttccttttctattattttctcaatatgtgaataattgatagcaaattcatctttagttctcacctgacataatgccatttcctagcattcttgtaagtatgtaaacagtaggataggaatttttctcttaaaggtattttaacttagcaaaaataatttcagttgttgacatatgaatctagcaatgctgttatcccacctgcttcctgctgcagggtttctgacttggggagagtctttcagctatgtcaccatgaatgaagatccaggggattgtttgtattagtttcctagtgctgctgtagtaaattatcacaaatttaatggcttaaaacaatacatatttggctgggcacggtggctcacacctgtaatccccgcactttgggaggccaaggcgggcggatcacgaggtcaggagatcgagaccatcctggctaacatggtgaaaccccatctctactaaaaatacaaaaaattagccgggtgtggtggcgggcacctgtagtcccagctaatcgggaggctgaggcaggagaatggcgtaaacctgggaggcagagcttgcagtgagctgagatggcaccactgcactccagcctgggcgacagagcaagactccacctcaaacaagcaaacaaacaaacaaacaaacaaaaaaccaatacgaatttatcctcttatagttctggaggtcagtagcctaaaatcattcttctggagctaaaatcaaggtgtcagcaaggctactttttttttttttttggagaagacagtctgttcccttaccttttcagcttctagaactttccttgtctcatggtccactttaacaacaccaggcagagtccctctcatgctgccatcactctggttctttctcttctgccttcctcttctgctttaaaggacccttgtgattacattcattccacccagatcatcagaataatcttcctatctcaaggtcatctgattagtgaccttaaacctatctgtaaccttaattctcctttggcatgtgacttaacatattcccaggttcctgatattagtatgtggacacctttgggaaccagaaatctgcctactacatacactattccattcagagttttaggacactccctctgatgctgttaagtggaccccgaggtcattcttgattcttcctttttggaatctgtggtaagacctttaggcagtggttatcttattgacttatgactcattgtgacgttctcacttacttcctcaaaaggagcagaaataaattcctttcattggcatatgacatctgttagggagtgaatgtttgtacttcctcccccatttatatgttgaaagtgactccccagtattggtattggttttggaggtggggcctttgtggagtaatttgggttgaataagatcataaggatggggccttcatgaatgggataaatacccttataagaaggtgccagagggctagcttactctctttacaccatatgaagatgtaacctggaaaaggtccctcatcagaacccaaccatactggcacccttatcttagactttcagcttctagagctgtgacaaataaatttctgttgtttataagccactcagtctctggtaatttgttatagtagcctgaaatgactaagataccatgttttccaagatgtctcagctctttgccagccagagtatcatttacacttttctctggagaaacttgttctgtactcagtctgttcactttttttcctatggcacttctttttgccactagcttttttttttttttactgtaatattgtcaaacatgctgtatcccagagccagtttcaggtgatctgcctgaaatggattgtggacccagagcaaccaatttaccctcttgatttctgttggtaatactaggatccccagagcccccattttgagccaggttaggcagatgaactatgccctgagcatctcttatgtcctgcagtgttcattctttcattcattcaacatagtaatcttgagtacctcctaagtgccagatattgtatcaagtggtagggatgtaacagtgaagaatggggaaagaaatcaccagcctcctgcaacttagtgtctagcagcagctatagttcatagatacagtcacatatttttctcccaaaataaactctggaatatcccagatttgggattctgttgatcctcactggcagcataaggacatgaagcagtataggcaactggaaaagagaaaccatagtcttccccttggaaaaaagcagcctatttcttaaaccaagatctttcaccatcttaatgtaaagcatataaggagaatatattaactttgggagactgtaacagttttcctttttctgatgtgtaatgtataccttatttcatctgcttgaactccattggctttcaattttttccaggtcttattgtttatcttctgccttgcctcatgatcccctttctccttttctttagccttgtcttacagctctctctctcattcactgattcacacaacatttattcactgcatacgctagtgtttagggctactgcttacctccctttctctttttttttctcttattcttcacatatctcctttgcctcctattctgacatgcttatactatgactagcaacccgctttcataaaatcttttctatgagcatacattggaacccttctagatacaagtagccagacaaggtgatcataaatgaaagactagtcttccctatatcaaatgtagctgtcatctgggaaaactgcatttacaaaatgcccaggtgggtagtacatgctctgacatttctctgtccatgtttctttactagatgcctggatctctaggaatctggtattcagcatagtggatgacacgtaggaaatatttgtggaattaatgaatactttttgtgatgcatgtctcttcctagagaatgtttgtttttctcaaaaacatgagccattccatacatggttgtattttgttatgctactgcacagagtttctgttgtatgtagtttcacaaaatatagcttttgttaatctctgcagatagtattaggaccaccaagttatctgaactgacatgtaattaatatttgcaaataacgataataagcagcaaatcagtaggattttcccatgggaagccatatttctcaaagatttctacatcctagtcagaggtgattcttcatttaaactgtgtagatgataatgggcaaagggaaattgtagcttcttttctctgttggagggcatgttttatttcttcttgttgttgccttcatcttttccccagtgcttcctgtgttgaccagatgatcacatccagctttaaaaccattcatggggatagtggctcaagccggtaatcccagcactttgggagaccgagacgggcagatcacttgaggtcaggagttcaagaccagcctggccaacatggtgaaaccccatctctactaaaaatacaaaattagccaggcatggtggtgggcgcctgtaatcccagctactctggaggctgaggcaggagaatcgcttgaacctgggaggcggaggttgcagtgagccaagatcatgccattgcactccagcctgggcaacaacagtaagactctctcaaaacaaaacaaaacaaatcaaaacaaaaacatttgtatctgaatacagtgttgatccatcttcccaccccttccttttttttttttttcttttgagacggagtctcgctctgtcacccaggccggagtgcagtgacgtgatctcagctcaccacagcctccgcctcctgggtttaagcgattctcctgcctcagcctcccaagcagctgggattacaagcatgtgccaccacacctggctaatttttgtatttttagtagagacagggtttcaccatgttggccaggctggtctcgaactcttgacctcaggtgatctgccagcctcggcctcccaaagtgctgggattacaggcatgagccacagcgcccggccccattcctctttttgactcattgccttttattttttttattactattatactttaagttttagggtacatgtgcacaacgtgcaggtttgttacatatgtatacatgtgccatgttggtgtgctgcacccattaacttgtcatttagcattaggtatatcttctgatgctatccctcccccctccgactcattgccttttaaagcatgctgtggtctccctctagtggagaaattgccatttcagaaagaaaaaaattcacagcctagagtcaggttatatttgttatgcctttatatttgaacaccttgtaaattgctgcttatcagtcaattttctgtttaggtgttgtagagtaaaaaacaatttttcttcaactctcgtaagttcttagtcagaacatacccttgtaacaaaagacaagattagtaggagaaaacaagctaattaatacgtatatttcatgcatacatgggggatacccaggaaatgagtaattctcaaagaggtagctttaaatttcaggttatagatcaccttcaacaaagaatagtaattttttaattgtattttttttaaagatgtgacaagacaaagtaaaaggactttgaatctctagtggcagcaacatctgggaagccaaataaatgagagatgacagctagttagtaaggcttgtttatataaattcctctgctaccatttctaggccaataagtgtctaaagttgtctttagtggttaacctttttaacctttgttctccctggtagaaaggggtgttgggttgggataccttcgtctttgtaaatctatgttctgcttttaggcaaatagagggagggcagagagctttcctgtacctgctgcttcttaattttcttcaggtcaacaattctttgtattttggggtggcatattatgaccttccatagtattgtatcttctgaagccaaacctcatcttactcaaaacagttaatcacctcctcttctctaccagttatgtacttagtgtaatttatattattgtagatttcttgctgttatgtagttacttctgggtatatctgttctgcttcacacttcagcatcttgagtagaatttcttaatcttgattgacaatcctatccagaatttccagaatgtttagtttaatggagtgttattatgggcctttgtattttccatgtccctctgaaattcctggaaatgtctgaaatttggaacagatactgttgtcagcaagttacctgaatggatatgtaaaaagcaggggtggcagagcttcttgggcagagcctctgttttttctttttctttttatcttttgacagagtctcactctgttgcccaggctggagtgcagtgacacaatcttggctcattgcaacctctgactcccgggttcaagcgatccttgtgcctcaacctccagagtagctgggactacaggcacccgccaccaggcctggataatttttgtattttttggtagaaacagggttttaccatgctggccaggctggtctggaactcctaacctcaagtgatccgcccatcttggcctcccaaagtgctgggattacaggcgtgagccactgcgcccggccagaccctctgttttcaacaacttcagtatttccatggagttccctaggcccattcattatcttttcacagcctcagcttggtgctcttatctctgggtaccttttagacattaacaacccatacctcttagatttctgaaaaggccaaaggaagatcttgtagttccacttctttgtttcttatgagtctttcttctccctccttccctcccttcctcccttcccctctctctttctctctgtctctctctcattatcctcttactcttcagagtcttcctgtcctgagaggcctttattccccagcagttcattatccaaggaccatgcatgttcctgagaggaacatgggtaggaccccctcagtgggtattggttgtttcaactaccccctagtggagaaactaccatcataggaaaaaaaaaaaaaaaaaaaaaaactacagagcttctatgtcagtcccaagattttatcaaattgtaattatttgtacactcccagtctgttcctcactccggtgcctaaggtgtagccattgttctatgtccatatgtacccaccagtcgtccgggagatcctaccactatcaagccaactgttgagtttgatagttaatttgccttctgcagagatgaaatacttgctttaatggctttggccatctagcctctggccagagttctagacataggatttgtgaacaccatggacttgaactcaggatttagatgtaagtggaaagtgacactaagataaagatggaatagggttgccaaatttatttattatgtatttatttattgatggagtcttgctctgttgcccaggctggagtgcagtggcgcaatcttagctcactgcaacctctgcctcccaggttcaagcaattctcctgcctcaacctcccaagtagctgtgattatgggcacctggccccatgcccggctaattttttttaaatttttagtagagacagtgtttcaccatgttggccgggctggtctcaaagtcctgacctcaagtgatccacctgcctcggcctcttaaagtgctcggattacaggcgtgaaccaccattcctggcctagggatgccaaatttagcaggtgaaaaacctagggttgccagatttagcaggtgaaaaacgaaatacagaatgctcagttaaaattcaaattcagataaacagatttaggacacacttacactaagaaaaaaatagccattgtttataagcaattcatatttaactggaaattctgaattttatctggcaattttaatctggttccagattttgcaggatcttatcagtcatgtgaaggattttagtccttagtatgtataatagcaatgagaaacggcagagggattttaaacagggaatttgtatcttgtcaaataatgattcgaacaggccaccaaaatagtcttctgatcaaacaaattcaggcttgttacttacagcactaaggaaggccactaccattgcaatattgtcttaataacctttcagaaggggaaaatcagatgtggagggattcatatttataaggtttttggagtctggtttgtggcaggtctttcattgttggggcctgaatgattgagattggacaaacttcatgatataattttatgtcaaaattatatcaaagtttgtgatatatttttttcaatagtttttatgtaaaactttgaagagtatcagtcatttgataaacccatttgagagatgttctgagaagtggctgtttactcagatgaggactgcttgataagcattgttcagaaaaattgatttccaggaagtttctgaaacaaagctattcacaacttcctcttactggaagaaatttcctggaatagtagttgaagttaatgcaaagtattaaatagaaacgtcatattaatgtgggtggtaaactgtatgcctgcctttggttccggttctctttagcctctgctggttattcttcagtcttagatgagcttcacaaactgtatgttcatggcacacttagtttcagtctaagtaatttgccagggtatctgtagtccaagagatgtacctaacgtctccatttattaagtaattaagttgaaccaacttagtaagtttgcacattcacacaacttagtagccatatcattcttattgaaagtatttttatcttgtcattaaatgaccctataatctttttaatgctgaatatgtttcagaaacattaatattaaaaataacgattttaataaaaaagatacctgctcatcctaaaaaattttaagcattaaaatgtgttcagaaagcgtagtgaaaattcaccccaaatcctactcaccaggaatacttattttttaacttggtggcctttattctaagtatatttctatgagtatacacataaactattttagaaaatttagatcataattgatgaagaaagaattatccatgatacttggatatagtaaggtagacattttttcaacagagactactgcattggggttttatagtaggaagagagattgagctcaactccaaatacaaggaaatttatatccaaggagcaggatgggtgttatggcttgaatatcccctcccaaactgaagcgtatctgccactataatgttatcaagaggtggagcctttaagaggtgattaagtcatgagggctgtattttcatgagaatgggttagttactgtgagactgggctcctgataaaacaataagtctggcctaattttcactctgtcttgaccaccaacttgcccagctgtcatgggatgatgaacataaagaccctcaccagatgacaatgtcatgctcttggatttcttagcctccaaaatcatgagccaataaactggttcataaattacccagtctgtggtattgttatagcagcagaaaattgactaagacagtgggaagcagtggatggagaaatgctaagaggaaacatcaggagtaaggagagattgtgagtaaactgacttgataggatacttgctcaaagccggatacagtgatcagatacctagagtaggagattttcactaaactgactcagcaggattcttactgaaaccagactatgtgggccaaagacaggacccaaggttgggacctaatcagaaagagaattcagaggaatctgactcaagtttgctcaaggagagaatctttttcataatataaatgttttatattctcagcagtgtcagagaactggacaaagatatacattattgcctctctcagagaataatattctgtaaggactaataaaagaaacatagaactaaggtagaatcataaaaattggaaaggaggaggcaatatccatatgttagagaggctatacttgttagaaaaatcaagagcttcacctaaaaaattcctgagaaggagaatttagtgagatagttgattgaaatttctttcctatatacaacaataaattgtataataaaatggaagaaaaattccctttgaagaaattaaccaaacataaaatacctaggtctaaactgagcaggaaatgtgtaacatctatatggagaaaagcttggaatgctaaaagggaactagagagaaggcttgaatatatacaaacacagagccactttttgaattgggatatccagtgtggtaaatatgtcagtttcttactgtataaatataatgcagtcacgatgaaaaatatctggaaattaatttgtttggaactaaacaatctgcttctgatgtttatatgtatgtatcaccttgagccgagagtcaggaaatatttgaaatagaagaaccatacctagaagtaagatatataagaaagttgcaattgacaaaaacaatttggaatttgtacatgcttagacagtgaaaacagtatagtgaattcaaaagtagacctgggctgggcgcagtggctcacacctgtaatcccagcactttgggaggccgaggtgggtggatcacctgaggtcaggagtttgagaccagcctgatcaacatggtgaagctctgtctctattaaaaatacaaaaattaactggatgtggtggtgcgcacctgtaatctcagctactagggaggctgaggcacaagaattgcttgaacccaggaggcggagcttgcagtgatccaaggtcacgccactgcacttcagcccaggtggtagagagagattacgtctcaaaaaaaccacaaaagtagattcaaatatatgtggcaatttagcgtatgataaaggtagaatttcagatcatttggaatgaagtgtttaattcagtttatagtgttgataactggccatacatttggggaggtatacatttcaccttataaaaccctttgcacaatttgaattttgaactcttcaacaaagagctagtttaaaaaataaattaaagggttgatatgattaggaaatttttaaatgtatatttgtctgtctctgtcaattcaccatgttcacagactaggcaaaggaataaaaatgctgccataggaaaacaaaacctacctaatatagtgtgtaatggggtattttgacatggatatatcagagatcaataaaattctcccaaatgtaagtattaatgttaaaatctccaaacttttctaattgagataatacaaaataacatatacactgccagtcaattggcataacattcctcttaaaatataggtctattctatgagcagctgatatggtttgtatctgtgtccctgcccaaatctcatgttgaatcgtaatctccaatgttggaggtggggcctagtaggagatgattagatcatgggggtgaatttctcgtgaatggtttagcctcatccacttggtgctgttccagtgataatgagtcagttcttgtgacatctggctgttaaaagtgtgtagcacctccccactctctctcttcctcccattctggccacatgaagtgtcaactcccccttcatcttctaccatgatgtaagcttcctgaggcctccccagaaaccgagcagatgttagcaccatgcttcctgtatagcctgcagaaccgtgagccaattaaacctctttttttttaattaaattatgcaatctcaggtatttctttataataatgcaagaataatacagcaactgaccagattatctagctgtgactgtatattcttaaaatttcatatagggttaatcaagcccccatttagggagtatttttgttacttttatttttaattgtggtaaaatatacatgacaaaatttaccatcttaactatttttaagtttattgttcattaatgttcattgtattcacattattttgcaacaaatatgcagagctcttttaattttgggaaactgaaactctgtacaacattaacaactttccatcctcctctctccctagttcttggaaaccaacattctatttcctgtctctatgtgtttgactactctaagtgcctcatataaatgaaatcaaactgtatttgtctttgcgtgactggcttatttcacttggtgtaatatcctctagattcatccatgttgtagaatgttttagaatttccttcattttaaaggccgaataatattccactgtgtgtgtctatgtatgtatgcatatatatatatatatatatgtatatataaaaacaatatgtattgttcattcattcttctgtggatagacacttgggctgcttctaccttttgtccactatgaacaatactgctgtaaacatggatatacaaatatcccttcaagaagctgcttttacttctttaacccatttatgcctagtgttccattattggaatgctaagcatgtaggagttatttatatcttactactcaaggtcatcatcaaggtctgattgcaaaaattcaaaaaaattgcaactgccagcataaatgggtttaagtatatgtcgagaaagtagaattgctgggttatatagtaattctgtttctagttttttaggaaccaccatactatgttgcatagtggctttaccatttcacattgccaccaacagtgcacaagggttccagtttttccacatcctcaccaacactttgaattttccttatttatttatttttgatatgtagccattctaatgggtgtgaggtggtatctcattgtggttttgatttgcattttccatgtgacaatgttgaatatcttttcatgtgctcacgggctatttatttcttttaaggaatgtctattcaaattctttgctcattttagaatcagtttgtttattttttgttgagatttaggaggtctttatatattttcagtattaacccctcatctctaacacacacacgatttacagatattttctcccatttgatgcacagaagtctttaattttgttgtagcccaatttatctattttttccttttctttcttgtgcatttcgtggcatattcaaaaaattattgctaaataaaatgtcatacagttttcccctatgttttcttctaaaagtttcaagcttttgctttcatttgggtctttgatccatttacagttaatttttgatatggtataaggtcaggatccaacttaattcttttgtatgtagatatccagtttctccagcatcatttgtttcaaagactgtcctttacacattagatggtcttggtatctttgttgaaaattattgcaccatatatgttagggattctttctgtgctctctgttctattccaccggactgcaggtctgtctttatgccagtaccacattgttttgagtacgattgctttgtcaaagacaagatgttccagaccattagggaatgtctttatttagactgttgcaatagggagaaccttcattattgaggaatatttcccaggagaaggagatttaaggctttttagaggcagattacaagagagtcatcatgaggcttacatgagtcatgaggtaggatggagatgtgtcctatatgcaaagacagggtagacttttgaagttacttgtttctgaggacacaaaaagatcggggaggtgtggtatttctaaaccattgatgcttccttggagcacagggttcaagtgaagttcatcatggtcactacagtttagtaaactttttttgtctggactttgaatagacaatgatttttttttcctttttcgaagatttaaataggaaaaaaaattcttgtttggtttaagtagttacatttcttttccagcaactctacaatttatttttcccaccacacatattataaatataaccaattatgtactcaaatttctctctgcctttcaaaataatactttgtgactcagaagacattttaaaaaatatacttaaaggaacataattattaggtatgcagtataaatttgctcctaaaactttttccatttttatagttgaaacaatcttacacataatgatgcttatatctactctctgtagggaagaatttgtaattctttcacacaattctgaatattttacaggttttgggggattttttttcttttttttttgagacagagtctcgctctgtcgctaggctggagtgcaatggtgcgacctcggctcactgcaacctccgcctcccaggttccagcaattctcctgcctcagcctcctgagtagctgagattacaggcacccatcaccacgcccagctaatttttgtatttttagtagagatagggtttcatcatgttggccaggctggtcttgaactcctgacctcaggtgattcacctgccttgacctcccaaagtgctgggattacaggtgtgagccactgtgcccggccatttttttggattttaaactaaccattccaggctgggctgagcgattcatacctgtaatcccagcactttaggaggctgaggtgggtggattgcttgagcccaggagttcaagaccagtttgggcaatgtagggagaccctgtctctacaaaatataaaaaaattagctgagtgtggtggcttgggcttatagtcccaactgcctgggaggctgaggtgggaggattgcttatgcacgggaggtcgaggctgcagtaagctgcgattgcaccactgcactccagcctgggtgatagagtgagactctgtctcaaaaaaaaaaaaaaaaaaaagaataagttaataaactaaacattcctgggaagactggccttaaattctcatcctaaatattagagttttaattttttcctacttttgaattattgaaacttcttttttactatcaagaagggctgactgtattttcctattgaaaacatatttgctaactctgcagtcatattcttttgttacagccctctcatttaaatttttcttgaattttgcctcttgttataaagggtggctttgtgttgatctttttcaggtttgtggttttctttcagagcaaagtaaggcagcttatttcttttgggcatttttgccccattttttaattgaagtacaattaatacacagtgaaatgtaaagatcttaactgtgcattttaagggaaacttcaagacatttgttcattgattcacaaaagtgcagaaatctcagcgatttttcaaaaaatgaactaacccatgtaaccggcactcagatcattcttggtaccccaaaagtccttttttgacacttcccatcacaatcccaccaaaggttaacctttatcaagacttttaacaggatagattagtttttttatatagaaataaaattacactctatataaatagtatatgctctcctgttttggcttctttcacttaacattaagtgaaattcattaagtgagattcatccatgccatggtggttatagtgttgttatagttcactcattctcaatgctgtacaatattctgagtcattaatgtaccatatttgttcattttgtgttgatggatattagggttgtatttttttttttctaatttggtcttgcagtctgtctctggaaagtagctataaactttattccccaacaggttccaagggatttggttgtggatgtttacaatgtgcctttcacaggatacttctttatcctggcagatggtatgatgcctaattgtctgaggtgtgaacaagtgtctttctcaccagaaattattttatactggcagatgcttgtggctattatcagacctgtgtcccgtttattcctgtcaagatagccactgtgtaggagaggcttaactgggagaaaagttaagtctgaatgtatcagtctggggagatataggtgtgtcagttgggtaatactatacagaggagacagcacaacaaaaacaggtgaaataatgtagacagtttattattcacaggttgatgggaaaacaggggtaccgacaggggctgttggaaatactgtagaggaaatgtgctcaaccagcaggtggagagataatgagttgaggcctttattgggtccagtatgttaccaaagcaggttacctctgatgagttctcattagtgggtgtagagcaagcaggcatgagttatactggatgaacgtctcgatggggaggttgtcaccgtggcatatctgcacagtccatgcatggtgtaagggatcaatgggccaagtcaattaggttatatctatgtgttccatagggaggtggtcatcaggaggcaattgtctaagatacatatctggagggaacacattaaggaattgggaggagacagagaactggaaactgtcaaggataatatggagcctggctcggtgtgagaaagttaaacttatattcagaacggataccgagacagcataaaattgtaagaattcactatgagtgttgtttccacttggggttactgcaaatataactgctatgagcattcttgtacctgtctttaggtgaacatatgtattcaattcttttgcagatatatctaggattgagattgctggatcaaggtgtatatgtatatttgggtttctaaaaagctttctttgggtaatttttttttacctattataaaatcactgatttgaagtgtgcaattcagtaatttttaccaactttaatgagtgttatacccatatgataaatctgtcatagaagatttttatgcccccaataagatccctcagctacatttacagttatatcctgtcttatcccagctccaagccaaagtaatcttcctatctttctatctccacaaatttgccttttctggacatttcataaaaatggaattatgatccatacctatgtggtatcttgtgttcaccttctttcacttagcataattttcagaaatcatccatgatatacccatgcatcaggaattcattcctttttattgccaaataatattctacagcttgtctttcccttcatgagttgctgagcatttgggttatttgtagttttgtctcatttgaataataaatcatcatgaatacttttgttcaagtctttgtatgaacatatatttttacttctcttgggtatgtacctgggaataaaatttctggcttgtatattaaatttatgtttagctttgtgagaaactgaaaaactgttccaaaatgactgcactattttacattcctgccagtaatgcatgaggagagggttcctgtttctacacatcctcaccaacgttcattattttctgtcttatatttattatagctatttacgagggtctgaaatgataatgtgttgtggttataatttgcatttcctttatgactaatggtcttggacatttttaatgtactcattagccagatatatatatcttcttttatgaaatgtctgttcatatcttttgtccactttttgattggactgtttattttctgttttttcttttcttttttttttatttttgagatagagttttgctcttgctgcccaggctggagtgcagtggtgtgatcttggctcactgcagcctccacctcccgggttcaagtgattctcctgcctcagcctcccaagtagctgagatcacaggcatgcaccaccagccctggctaagttttgtatttttagtagagacagggtttcaccatgttggccaggctagtcttgaattcttgacctcaagtgatctgcccgcctcagcctcccaaagtgctgggattacaggcgttagccaccgggcccagccatatcttcttactgtagacttctaaagattctttctaaattctggtttgaagttctttatcagataagtgttttccaaatattgtctcacagtctgtaactgaccttttcattttctctttctttctttttttaaaaatcaatatatatgttttcatttttttaaattttttttaaaattattaatttttgtgtgtacatagtaggtatatatatttatgagttacatgagatcttttcatacaggcatgcaatgcataataatcacatcatgggaaatagggtatccatcacctcaagcatttatcctttgtgttataaacagtccagttatattttttagttattttaaaatgtataattagattattactaactataatcaccctgttgtgctagcaaatactaagtctgttcattctttctaaccatatttttgtacctattaaccatctccactcccctgcttcttcccagactcttgtaaccatccttcaattctttttattttattttattattattatactttaagttttagggtacatgtgcacaatgtgcagtttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcagttcccacctatgagtgagaatatgcggtgtttggtttttttgttcttgcgatagtttactgagaatgatgatttccaatttcatacatgtccctacaaaggacatgaactcacattttttatggctgcatagtattccacggtgtatatgtgccacatttccttaatccagtctatcattgttggacatttgggttggttccaagtctttgctattgtgaataatgccgcaataaacatacgtgtgcatgtgtctttatagcagcataatttacagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcgtgtccttcgcccactttttgatagggttgtttgtttttttcttgtaaatttgtttgagttcattgtagattctggatattagccctttgtcagatgagtaggttgtgaaaattttctcccattttgtaggttgcctgttcgctctgatggtagtttcttttgctgtgcagaagctctttagtttaattagatcccatttgtcaattttgtcttttgttgccattgcttttggtgttttagacatgaagtccttgcccatgcctatgtcctgaacggtaatgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaacggggaatcctttccccattgcttgtttttgtgaggtttgtcaaagatcagatagttgtagatatgtggcgttatttctgagggctctgttctgttccattggtctatatctctgttttggtaccagtaccatgctgttttggttactgtagccttgtagtatagtttgaagtcatgtagcgtgatgcctccagctttgttcttttggcttaggattgacttggcaatgcgggctcttttttggttccatatgaactttaaagtagttttttccaattctgtgaagaaagtcattggtagcttgatggggatggcattaaatctataaattaccttgggcagtatggccattttcacaatattgattcttcctacccatgagcatggaatgttcttccatttctttgtatcctattttatttcattgagcagtggtttgtagttctccttgaagagttccttcacgtcccttgtaagttggattcctaggtattttattctctttgaagcaattgtgaatgggaattcactcatgatttggctctctgtttgtctgttattggtgtataagaatgcttgtgatttttgcaagaaggaatggtaccagttcctccttgtacctctggtagaatttggctgtgaatccatctggtcctgcactctttttggttggtaaactattgattattgccacaatttcagagcctgttattggtctattcagagagtcaacttcttcctggtttagtcttgggtgggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagtggtctatcaattttgttgatcctttcaaaaaaccagctcctggattcgttaattttttgaagggttttctgtgtctctatttccttcagttctgctctgattttagttatttcttgccttctgctagcttttgaatgtgtttgctcttgcttttctagttcttttaattgtgatgttaaggtgtcaattttagatctttcctgctttctcttgtgggcatttagtgctataaatttacctctacacagtgctttgaatgtgtcccagagattctggtatgttgtgtctttgttctcgttggtttcaaagaacatctttatttctgccttcatttcattatgtacccagtagtcattcaggagtaggttgttcagtttccacgtagttgagtggttttgagtgagttttttaatcctgagttctagtttgattgcaccgtggtctgagagacagtttgttataatttctgatcttttacatttgctgaggagagctttatttccaactatgtgttcaattttggaataagggtggtgtggtgctgaaaaaaatgtatattctgttgatttggggtggagagttctgtagatgtctattaggtccgtttggtgcagagctgagttcaattcctgggtatccttgttaacgttctgtctcgttgatctgtctaatgttgacagtggggtggcatccttctattctttatgtccatgatttcagttgttttgagttttagatctcataaataacttgagaacatatgatgtttgtctttttgtgcctggcttattttccttaacgtaatgatctccagttccatccaggttgcagctaatgacagaatctcattctgaatcatactccattgtgtataagtactacattttctttatccattcatctgttgatggatacttaagttgcttccaggatcttggctattgtgaacagtgctgcaacaaacatggatgggcagatatctcttcagtatacagatttcctttcttttgggtgtatatatatatatatacacacacacatatacacatatgtgtatatatacatatatacatgtgtatgcatatatatgtatacatgcatatatgtatgcatatatatgcatgcatgcgcgcatgtatacagatatgtatacatgtgtatatgtatacagatatacatatgtacatatatatacctgtacatacatatacacacatatacacacacacacacacatatatacacacatatatatccaacaatttgattgctggattatatggtaactcaattttgagattttttgtggaacctccaagttgttatctatggtggttgtactaatttacattcctaccaagagtgtacaaaggtttcctttttctccacatccttgccagcatttgttacttcctgtcttttacataaaagccattttaatgagataagatgatatctccttgtagttttgatttgcgtttatatgatgatcagtgacattaagcaccttttcatatacccatttgtcttcttttgagaaatgtctgttcattattagactttttttctacacagtagtttgagctccttatataccctgactattaatcccttgtcaaatgcatagtttgcagatattttctcccattctgtaggttgtctctttgctttgttgattgtttcctttgctgtgcagaagctttttaactttatgtgatcccatttgtccatttttgctttggttgcctgtgcttgtggaatgttactcaagaaatatttgcccagtccagtgtcctggagaatgtccccaatgttttcttttagtagttttatagtttgaggtcttagatttaagtctgtaatacattttaatttgatttaggcaagagatagggttctagtttcattcttctgcatatggatatccagttttcctagcaccatttgttggagagactgtcctttccccaatgtatgttcttgaaacctttatcaataatgagttcactgtagatgtatggatttgtttccaggttctcaattctgttccactgacctgtgtgtccgtttttacaccagcaccttgctattttggttactatagctgtgtagtataatttgaagtcaggtatatgattcttccagttttgttcttttagattaggtcttttttctgttcattttctcatttagttcttctttatttttaatttttttgagatggagttttgcttttgttgcccaggctggagtgcagtggtgcaattttggctcactgcaacctctgcctcccaggttcaagcgattcttctgcctcagcctcccgagttgctgggattacaggcgcccgccaccacgcccagctaatttctgtatttttattagagatggggtttcaccatgttggccaagatggtcttgaactcctgacctcaggttatccacccgcctcagcctcccaaagtgctgggattacaggcgtgagccaccgtgcctggccaatggcttatttttaggtgtgaaagttttgaattttgacaagacataatttattatttctttctagtattcactacacccttggtttcatatctaatgaatctttgcctaacccaacatctgaaagatttttaccaatatgttttcttgtaaaaatttaaatcttctaaccccttcatgtaggtgtttgatgcattttgagttaatgtgtgtatatggcatgcattgtggatctaaatgcatctttttgcagttgttcatgtgattatataaaacacaattcctcgagtaggcttcccttctccagtgaattgctttggcacctttgctagaattcaatgaacttataaatgtagtttttgaattttatcatactgatttatatgtctttccttatgcctggtttacaccatcttcataactaactctatataggcatacttcactttagtacacttagctttattctggcatacctcatttcatggcattttgcagatattgtgtttttaaacaattatttatataaattgaagcactgtggcgatgtactgagcaagtttcttggtgccattttttcaacagcatgtgcccacttcttatctctatgtcacatttttgtaaatcttggaatatttcaaactttacaatttttattatatctgttatggtgatctgtgatcattgatctttgatgttactattgtaattgctttagggtgccacaaaccacgctatataagatggtaaacttaatctgtaaatgttgtgctgtgctctgccaatcagtagttccttatctctgtgcctctccttgggcctccctgttccctgagacagcaatattgcagttatggcaacgaataactctaccatcatctcttagggtccaagtgagtcacacatctctcactttaaatgaaatgctaaaaatgattaagcttaatgaggaaggcatgtcgaaagctgagataggccaaaaactaagtctcttgtgcaaaatagtcaagttgtgaatgcaaatgagaaatccttgtaggaactgttttttgctaaaaagttaaaagtgctactccagtgaagacacaaatgataagaaagaacaacagccttatagttgacatggggaaagtttgagtggtctggatagaaggtcaaaccaaccacaacattcccttaaaccaaagtttaataaagagcagtactctaactcttcaattctttgaagcttcagaatggtgaggaagcctcagaagaaaaatttgaagctagcataggttgttggttcatgaagtttaaggaaagaagctgtctctataacataaaagggcaaagtgaagcagcaagtgctaatgtagatgcatgttgtctagaaggtgtagttagaaggtgtagctaagatcattgacaaaggcggctacagtaaaatacaacttttctatgtagatgaaacagctttctagtgaaagtcctatgtaggacttccatagctagagaggaggagaagtcaatgcctggcttcaaagggcagactgactcttttgttagtggctaatgcaacttgtgatgtaaagttaaagccagtgctcattgaccattctgcaaatcctagaccccttaggaattatgctaaagccactctgcctgtgctctataaatggaacagcaatgtctggatgaaaacacatctgtttacagcacgatttactgaatattttaagcccactcttgaaacctctgctactcagaaaaaaagattcctatcaaaacattactgctcatatgcaatgcacctagtcacccaagagctctgatggagatatataaggagattaacgttgttttcctgcctcctaaaacaacatccattctgtgtagctcatggatcaaagagtaattttgcctttaagtcttattaagaaatacattttgtaaggccatagctgccataaacagtgattcctctaatggatatgggcagagtatattgaaaacctggaaagggttcaccattgtagatgccattaagaacatttgtgattcatgggaacatgagcagttcaatgaattctattacactatgagtgcttttggctagattatctagctttttgaccttggacacattatttaatgtagagcctgatctccatctataaaatgggaatcacagtagtacccacctcatatgaccgttgtgaggattagatgacattttatatggaaaatgtctgcagtaaaccgtccataaatggaaggagttttttaaaaaatgttgttggtataatcaccattatgatctttatgattctatgttttaatttcattttataatttatcctgtgattttttttacctcagcatcaccctttataggatataaccacatttcttctcaatacctataccaacagcactaatcattaaagaaatgcaagccaaaaccacaatgagatacacgtcacacttatttgaatggctgttattaaatagacaaaagataacaagtgtttttgagagtgtggagaaacaggaaaccttctatacagttggtaggaaggtagattagtacagccactgtggaaaatagtatgaacatttctaaagaaattaaaaatagaatgaccatatgactcagcaatccctcttctggttatatacccaaaggaaatgaaatcagcacctcataatcatgtctgcattccgtttttgttgcattgttattcacattagtcaatatatggaaataaccagtgtctgttgacaaatgaatggataaattgtggtatatatacacacacacacacacacacacacacacacagaatggattttcattcagccttaaaaaagaaagagatgtgccatttgcgacaacatggatgaacatcataatgatattagcccaaaagagaaagaaaaatactgcatgatctcatttatatgtggaatttaaacaacaaaaaaaaattcagtggtttttgtgtaaattagtacaatagaagatccaaggtagagtactttaaattagcaagatatttctaactgtgcattttaagaaccatttttatttttcttcagtttggaactacaacctttagatatcaaaatgccctttgtaacttaatttttattcttttttatgagagaggtgcatgtttttcaagtacatttatctgttaacaaaaatagttggagttcgcgaaagcctattatttaggcaaagtcttcctttgcaaagattcagactaaagtactagcaggttttaaataatacatgatttattatattttcttgtttttgaactgagacataaaatatcctttaacttaaaaatatgttttattatttaataataaaagaagttgtttcttcaagctaaatgcctggtaaatacattttattatgtgatcagcttgtccgtattctaaaataatagtttatgacttacatgagcctattttttcacttgattaagtaacataattagctgatttacaatataaaacatattcctaaaacccttttcagctttgaaatttcaaatgccactgtttccatataatgacatgtgaatttacattttagaaagcataatttaaaattatatacctctatatttttaaggttcttggcaatttaagtagaataatttccatagagagacaattcttccctcctactctgtatgtactctaatgttgtctacttctttcttctgttcctgcagtgttacttacgttttttatactatccagaggcttaggctgtttgcctttgatgacatggatatatattgctcagtcatacgctttcaaaaaataatctcttcatttagtttttttattattttattactattaatttataataaaatttggtttatatgaaggatcttaaataacatatataaggtataatcaataatataatgagtctataagaactcagcataaaaaacagaacattttcaatagcttgaaagcctcctgcataccccttcacataaccctcccagatcatattgctttcctgttctgatacagataaccagtatctggaatttagtatttaacattcctttacttgtttttctttttataggtttactatatgttttagtttgtgctaagtgaaatggccactactcaaccatttttggtctataattataggaattttatatggttcagctgagtacacacatacacatgcacactcccaaacacactggcctgttgttgaacattatataagtgatgttacagtgtagtattcccactactttctttttttactcaacattatcacctagagattcattcatgttgctgtgcaaagctctatttaataaatttgtgctgccatatagtattccgttatatgaatattccccaattactttataaattttcttgtttatggacgtttattgctgctttcaggtttttggtgttttgacttttataagtaatgctgccatacttcttttttcacatatcccaacaagtgtctctaggtaggtatataaagtagtgaaattgcagagacctagggcatatacatattcaatttttataaacaatactaattttccaaagtaattgaccaaaagtatacttttaccatcagtgtaaagattgttcctttgtactaaatctttatcatttttttattttctgttttttaatatttgctcctctggtggatattatgtggtatttaattgacctttgactttgcatggtatctaattgaggttctaattaaggttctaattattaatgaagtaatgaagtggaatatttttaaatacatttattatccattcatttttcctccattttgaatgacctgctcatgtcgtattctggttttggtattagggtaatatcggcttcatagaatgaattgggaagtgttctttcctttcaattgttggaagtttgtgaaggattcatattaattcttgaagtttttggtagacttcaccaaattaataatttttaattagtaatttaatctctttactcattgcaggcctattcagattttctatatctttttgagtctattttcttagctggcatctttttaggaatttgtccatattatctaggttatctaattgagtgtcatacagttggtatatctttttgatcttctgtaaggttggtagtaatgttctctttttcgttcctgattttactaatttgagtcttctcttttttttctcccggtcactgtagccaaagatttgtcaattttgttgaactgtcatatgtttttcatatttcgttaattatgtttattttttgattctctatttcattaattttattatttcctttattcttcttgctgttaggtttactttgctattttcccagggccttaaggtaagaagttaggtgattgatttgagatatttcttcttttgtaatataggcatttacagctttaaatttccctgaaacacactgcttttacctgtatcacagaagtattggtatgttttcatctctattcatctgaaaatattttctaattttcattgtaatattatttgatgtgttggttttttaggagtatattgtttaatgttcacatttgtgaattttcaaaatttctttgttattgatttctaatttattccatgtgctcagagaacatactttgtattattcctgtcctttaaaattattaatgcttgttttatgacctggcttatggtatattctggaatatgttcaatgtgtatttgaggagaatgtgtgttctgctttttttgaatggcatgttctatagataatctgttatgtatacttagtttataggcctattaatgtcttctatttcctattcatcttctgcctagttgttctattcatcatttaaagtggggtattgaagtgtgcaactattattgtggaattatttatttttcccttcaattctgtcagttttgctttaatgtactttggtactctgttgttagttgtatgtgtgtttatactttatatgtcttctggatggattgaccttattattattattaaatattcctctttgtttctactaatattttttggtttgaagtccatttttttctatattggcattgccactccagctttcttatgcttgctatttgtataatatatgtctcccttttacatttaacataattatatgtttaaatctaacatgtgtttgctatagaaagcatacaactggatcttgtttttttttttaattttccagtctgaaaatatgtgccttttgattaatttgtataatcaattaatagttaatgtcattattggcatgggtgcacttatgtctgtctctttgttttctatatgcataatcttttctgttcctctgttcctctcactggtttcgtttgtattaaatggaaattttttgttgtaacattttaatcctttaatggtattttcttattttactcgttttcttaattgttgctctaggacttaacaatttatgtgagaacttaccagaatttctttcagatgttaaattttcctgagctgtagctatttcttctcccttttttggtgctgttattacacatatgacgtctaaatacgttatgtaactccaacaatacattattacaatgattacttttgatagtttttttgtcttttactgaacctgagagaggaatggagagcaagtatataattttaaaaacttgttgattaaacttctcatttactatttctaatgttcttcatttcttggtatcatacccagctgttatccctgagtaattgttgaccgattgctacattgactttgacagtttcctgggacataatctgctccacagtgatacatttatttttggacccctttgcaggaatagtctttgaggccagtgtttcatgcttgctccagccataggtgggcttttctcagctatgtgtttgtttctcacttgtaaactggctggcctatgatttaaagagctcattaaactactaacctcctcataattgcttaccacaaaaatctacactgttttcagggactcccttaggctcaaacttccttacactctgttttaaataaaaatcagttcccttctagagagccttggacctgttttttaatagcctgcctctccccgtgggcagaacatatgcactaaagctttgggaggtaggggtggggacagtgtcatccttctctcagaatggcatccatgctctaggaagaggacattgggtaaaaacagtaacccgtggtcttcttggcttccccctccctgcatggaacctctgccttgtgaattagctggagcagggctgattggggcctagtattctcagattacttttcctagggtagagcttccgtcctgtgactggtcacttgattgaggaaaggagctccagacctctataacatgattgcctccatagagcttttgtaacctagagctgagggtaggatgaaaaattccaatcacctgctagagggaaaagtgcatgcccttggtttttggctgccccagccataagcaaaactttatcctgctaagccatccaggggaagggggagggagcaggttgtggctcagatgccacagactcttgctcttcttactgagatttcatagattttactaaaaatgtttctccatttgccgtataccatcaggacagattctagagactctaaatggttatttttcaaacaaataattttccccagttgtggttgttttgctgggagctcctcatgttgccattgcacatgtatctcttctaacgtggagaaacatttgacatacaaaaagtatactgtaataataacagtctaaccaaactttccagacaacagcaggattttcctccaacatctgtgtttgatacacagttgcttatattttgtttgtactcttgtatatgtcactgccctgcagccacagtacctacctgtgtttgaaaacaggtccagcctatacctgcctttggcctttgcactagctagtttctctttctacactgcttttgcgcaaggctctttctccattttcttcagatctcaacataaacttcaccttattgcagaaactttcccatatcactggatagaaaatagcacctctttggcaggcacctgtagtcccagtcccagctacttgggaggctgaggcaggagaatggcgtgaacccgggaggtggagcttgcagtgagcccagattgtgccgctgcactccagcctgggcaacagagcgagactccgtctcaaagaaaaaaaagaaaaaaaagaaaagaaaatagcacctctttatctctcttgatccctcatatttcattttaccaatacttaatgtattttgtcatatattttaattatttgtttatcctttctttgccatcgttagtacttaagctccataggggtatgaattttgtctgttttgtgttttgtggtatgcctagtatgtagatcagtgccatgcacaaagtagactttttattttattttattttgttatttatttaaatttccagttttattttagatacagggggtgcgtgggcaggtttgttacatgcatatgttacacccaggtagtgagcatagtatctgtagctagtttttcaacccacgccctcctctttcttcccccgtctaatagtcttcagtgtctattgggcccatgtttatgtccaggtgtgctcaatgttttgcttccacttataaatgagaacatgtggtgtttggttttctgttcccgcattagttcgcttaaaattatggcctccagctgcatccatgttgctgcaaaggacatgattttgttctttttatggctgcatagtattccatggtgtatatgtactacagtttctttatccaacatactattggatggtatacttttaataaatatttttagagtgaataaatgagttacagtatggcaattttatctatccccagaggagcactgtccaatacaactttctattatgatggaaatgttctctgtctgagttatccaatgtggtagatgctagttacatgtggtcactgaggatttgaaagatagctagtgcaactgaggaaatatattttaaattttatttaatataaattcagattaaattaggccaagtgtgcatatggttactttacagcacaactccaaaaagtcgtccgccttaccatggcatcttttcaaggcataatttttaccttttattcctattcatggagttacttctagcattgctggtattgtcatcatttttactacatactatgtgcactgtaagcatcttgggtctttatagaaactccctttggttatacttgctgtcaataaacaagagttcaattatcgggatttgtctacaaatgaaattacatccttaattttgcttgattttggaaataagcatctagttgtctcttcatttcttctttcatatgtgatacattttgtaaattttttcaagtcatattgtttttgcaataaaatggcatgaagtactgatgcataacaacatgaatgaaccttgaaaacattatactaaatggaagaaggcagtgataggagatcaaatgttgtttgagtgcatttatatgaaatttccataataggccaatctacagagaaagaaagtcgattagtggttgcccaggctggtggggaataggggaaatggggactcactgctgaagggtttgggctttctttctgcatgatgaaaatgttctataattagttatggttatagttgtacaatttgtgaatatactaaaagcctctgaatttcatatttcagtatgtttgtgtgtgtatgcatgtcttatatttttatatttattttatcttttttctttttttatcttttttttttcaaattacccagaatctgagatgtgtttttttttttttacctcttccttcagagattctgattcatcagaactaagatgataatctgcattttaaacaagcaatccaagtgattctgatttaggttgccaaaagatttttttctttaagaaacaatgctttaggcaaggatgttattaatctttctttaagaaatttctgataaagtagggaaatgcatatctttcccctaattatatatgaatatcctggcctccctgataccatggttatattttgaactgaaatttgtagttattgatgatgctgacacattttctctgtatttggcatgccattgctattttagacatataaggacactcaattgctgtatggtactcagatggctttatcttatcagttgaaatttcttcttattctttgtatttttctttaaaaaatagatttggtacttgccataccataacctctgttattacaactgttttaccattactttgaaacctattgtagagaaacaagaactctttctctacattatcccagtcttcacattttgtaagctgcttatcaggttgggttttctagtaagatatcagaagcacagcctacacagggcagagtatgtccaacatgtggtggtgggcaatctgtgtcttaatcatctggaatgtttgttaaatatcctgggatctgagaatcaaaatttctgaagaggtagtgtattagtctgtttttacactgctgtaaagatactacccgagactgggtaatttgtaaagaaaaaggtttaattgactcacagatccacatggctagggtggcctcaggaaattcacagtcatggcggaaggcaaaggggaagcaaggaccttcttcacatggtggcaggagagcagcatgggggaaactgccccctgatccaatcacctcccaccaggtctgtctctagacatgtggggagtatggggattacaattcaagatgagatttgggtggggacacaaaggctaatcatatcaggtagcttgagtatacaggttactatcatgtccactgaagtctgagagcaactgacgtaaatttttcattttcctttttttgtgtgccaaaactgtagatgagagaaccactgatttatgtagtgatctgtgcctttatgttctctaatacacaacttcagaacagttttaaaattcattctgattcttccttaacttggtcattatatttgcttttcttgggatgggtagaattttgcagtttcacttgaaactgatttttgcctctctacttgatcttgcttgtctaataaaaactgtgctttgcaccctctagcatgctttttgtcacctggctctactcccgatttctacactacttaacttggtcagcatagacttcacctttaatagacttaaaaaaaatctctgctactccgtttatgtgtgtgtgtgtgtgtgtgtgtgtgtgtgtgtggtgtgtactattgttctgctaatgttcttttatgctttggtccttcttataaatccataaaaccatagggataacagtattacaattttaaatacctgtaacctctgacctttcacagaaaatatgaaatacatagacgtattgacctgaccatttctaaattgctatggcttctaaccttttccagcaatctgaaaagttgtgggaatttatattctatttgtaaagaaaggactaagaactgtgacttcaaaataagaatcatagtagaccagttataaaatgcactatctaaaaaggtatgcttcacatttatgatcccggtatttgcattctgtgtcaaacattaaatatgagagaattattccaagagagatgaggaagaatcgatataattttagctggcagaatttattaacatatttgcttatcagtcctcacaaattatgagctgtccttaggtgatatatttatttggattctgctgtgttgttttggtggcaacaccatgcctgaataggtgaaaggggctctggaatctagatacttgccttaaaaccttgtccctgccatctgctagttatgctgctagtctagttggctctcctgtctgagcctctctttctccacaggtgaaaggggaaaataatagtgcccatgtcatagagttatagtgaggaacatctgaaataattcacagaaagcacttagtgcaatgtttggcatatggtaagcactctgtaaatattagctgctattattttcatgattgttaataaaattgctgccaatgttgttctttgtctacagcagtgtttcttaacctttttagacataaggtccttctcttataacgaacatttggtaactcctcctttaatattatggaatgaaaatcaaagatctataacctgtatacatataattttgaaaaatgttaatattattctttaatggtaatagaaacaaaatagtagtccagggctacagtgtatgaccactatatcataaatccccaagacctgtctcaggttcataaatttactagaaggaatcacggggtctcagcatatacttgtattagtggctgagggttattataatggcataagtgagaacatatagccaaatcataagggaaaaagacacaggtggcatgtgcaggaatccttgtgcaagcttccttacgctctctcccttcaacaaggggtcacacaaagcacattcttaccccagtaacaaaaagaaagcaacacatgcaatgtttctgtctagggaaggccattagacactcaatgttcagggttttccttgggggctggtcacactctctgcctcatacttaccacaattacagataaaagaaggtattcagtcatattatttgaagtgcttgagagggtatctggtggtctaactgcttcttctacagaatttcagtcatttctcctattttcagctctaccaaaactcaccacttacataagtaatcctgattggtatggctttctgaggtttggtgccacaagacagcttatttactattggtgtcaaaatatttaagttggtttgagatttttctggtacaacaagctattaataatttgcccatttgctttctttctttcttttttcttttttttttttttttgacatggagtctcgctctgtcacccaggctggagtgcagtggcgtgatctcggctcactgcaacctccgcctcccgggttcaagtgattttcctgcctcagcctctcaaatagctgggactacaggtacccgccaccacacccagctggtttttgtatttttagtagagatggggtttcaccatgttggccagtctggtcttgaattcctgacctcacgtgatccacctgccttggcctcccaaagtgctgggattacagatgtgagcctccacagccggcctgtgtatttactttctaatttacaacattctgttaacagctattgtctgccctatagcctcccctactctctatacatgtacattcttcaataagtcaacatgagcatgtttacttgctgaccgtaaggagctagcagattagaagtggatggagatattaagagggaatcaatagggtaaggtcaggccaagtggggtggctaacacctgtaatcccagcactttgggaggccaagacaggtggatcacttgagtccaggagttccataccagcctggacaacatagtgagaccttgtgtctacaaataatacaaaaattagctgggcatggtggcatgtgcctgtggtccagctacttgggagtctgaggtgggaggatcacctgagcctggggaggtcgaggctgcagtgggctgtgattttgccactgcactccagtctcggggctacactctgtctcaaaaaaaaaaaagaataaaaaaataggataaggttctgaggacaatgaagaaagggtctgagatgtggagcacttattgagagatgagcctttgataggaggatggcctcctctttcattgtaacaggaggttaagaggagaggttttagtaaacacaagaaactttgtcaatttgggaaagaaaagagaaggacgtgtttgtatggtggtttctgccttctctatgaagtgtatggtaaggctacctgctgagaggggtgatatggtttggatgtttgttgccacctagatctcatgttgaattgtaatctacaatgttggaggtggggcctcatgggaggtgattggatcatggagatggtttctcatgagtgggttagcatcatcccctcagtgccattcttgtgatagtgagtgagtaagtcctcgcaagatctggttgtttttaaagtgtgtagcaccccctgaccccacccctgtttcttctgctctggccatgtagacacgcctgcttccccttcaccttccaccatgattataagtttcctgaggcctccccagaagcagatgctgccatgctttctgtacagcctgtggaaccctgagccaattaaacctcttttctttataaattacctagtctgaggtagttctttatagcagttcgagagcagactaatacaaggaagtaaagatgtgagggatttcaggtcttgggaaattggaggaagtttgaaataaccgtttcaagggagggaaggagtacattgacctgagaacacagacttgctagaaggtgttaaatgcccaggggagattgttgattgtgagtatatggtgacaccagtcttacctgttgtgtgacttttttagcagcatctagctgcccctgtgcaggacttgtcaatgctgggttcacctcatccaggggtggactaaaaactgttgataaaatcataacaggttgaatgttactgcctatgaagtttaaggtctttccttgctcagcatcattttattttcatgatggtttgttggaggatgggtctcgatatgtctttcagcctcaattgactcatacctactaagactggaaaggcatgctctccagccagctgacctcttgaatatacgatgacaaactattatctgctgcctgtttttgtaaaataaaagttttactgaaacatagccacacccattcttttacttgttgtctatggctgcttttctcctacaatggtagaggtaaataattgtgataaaaactatatggcgggcaaaatctaaagtgtatatgtggccctttacagaaaaagtttgccaacctctggcctctaggcagctgtctgaatcctgaagccactgttacactgtgtgctgtttactgacattttttcccttaggtggtgtcatagtcctgcatttttggcttcttaatctagttccttacttaaatatgattcaagtactttcttttcttccactaaataaattttacatacacacagagagatagagagacatgtatatttcaataagttctgccaatgtgaattaataaataagaagtgttataataataatggacatagaattccaatttcagactcattttttaatcacaaaattctattactgacaaatatgtaggtactcttccgtacaaatttttctgagttacttaatttctcctggcctcacctctttgggaggtaatttagatgaaatggcttaaaaaagttatagtttcacaactattcctcaaagtcctagaatctttttactttgctgactctacttgcttaattatatttgctaatccatttcattagtcaacacttggcaagcccaagtgtactcatctgtctattaccttttcatctactttagtcttaagtaaacaaatgccagttcatgttctcagatactcagatgtaggtttaattgttaatatcttattcattattgtacaagcttttgctgttgaattttaatattaaaataatgataggttagatttgtgctcacaacttattattatgttccattttttcccactcaaccgtacattatgtaccctttcttcaagattactgtacagaatgattcttacatatttcagtgtgacattctttttttattgaggtggaattcatatattaactattttcaagtaaaagttcagtggcatatcatacccttacagtgttgtgcagctgccacctctatctaatgctaaaacttttccctcaccctaaaaggaaactccatttctcttaagcatttgctcctcattcctgtttttctcctactctggtaaccacccgtcttatttctttttttgtaaatttccctgttctggatatctcacccatatctagatgattctgtgtggtgtgtaatatgtgatattttatgttaggcctctttcactgagcataatgtttatgagttttgtccatattgtagcatgttcagtttttcatgctttgtcatagttaataatattcccttgtttatatataccatgttttgtttatccattaatccattgatgaacatttgagctgtttccgccttttagttcttgtgaatagtgctggtatgaacatcaatgtccatgtacttgtttgagtgtctgttttaaattttttttttttggtatataactaggagtagaattacaggatcatatgacaatttcatatttaagttttcgaggaaccatgaaactgtttttcatagcagctgaaccattctacattcccaacagcaatgtatgaggatcccagtttttccatatcctcaccagcacttctaattttctagtgttttgattatagccatccttgtgtgtgtaaagcagtatctatttgtggttttgatttgcatttccctacagattaatgtcaagcatctcttcatgtgcttttggccatttgtatatcttctttgctgatatgttcttgttcatcttatttttccttcacaactggagaagacagggtatatataaatgatactaattatgagaaaaatcatagtcatggaaaatcttgagacttcaggtcagtagcttcatatctaccatggaggttaatttaatgcttgttagctaaaactttggtaaaacttctcataaattggtttgcttcatattcattagagccttccactcaaagatgtgataattgttattttgactatttgcaagggatttggaaaggtcagtgtatgtggtgatttttcatttggttggttgaattatgaaagctgcaggagcaaggagtcatttattggaatgagtcttgcagagtccttaaaatacatatctcagatatggctttgttattcttcataatgacatttctgaatttgggaattctgacaaagtatctgcaggaccacattatggctttcatgggcaataggtacttttgttttgtgggccatgaaaaattttgctacataaaagatattaaaatatctttcagaaatactaaaaatttccatgaaaatattataattctattttctgtctacattgctatagagatgaatattttacaggctgtcttgtattcatattttcttctgattttaaaagaaattaaaacattacagaacctctaacagtatcctgggcccaaggcattatgcttgctttgtgcagtgggatgtgggccctggatatctgaagatatctatcatgattttgtttagccctttgtgatttttattatcattgatgtgtgagttcttaacagttactgtgattacttcctaataataatgtgctctttacggctactttgaaatgtccatttcatataactcagatcataataaacttgccctttttcctcattttcattatgggctcagccgtctcagcttgttcaattttatttgcattttcctcctcatattctgcttgttaccatttgagctctcagctgctggaaagcccttcccagagcaggtctttggggataacaggtttcactaaattggtttcagaaggtgaagtttagtgttcatttggtctccactggcagccctgaggagatatgataacacaggctggaaaagaaaaattccaatttcataaagagcattctgtacagtgttggcataaacaaccctgatactagcaaggagaacagactagctttgggatagtatacaagtttattgctaactcttcttttttatggtgttatcatattatcgtatcctttaacatcctttgtggtttttttcttgttccatgttcacttttccaaatctcattgcctgtcatcatcttccttccatcactggcattttttattaatgatctgctttctcctttcccataagccagtcttagtgtcttctagcaatgtcatttaaaatcccacttcctcattcaagccacagtccatagcactaagcctttcttcttcctttctcataactggaaataacagatctctcaggaaaccttcatttcccttactgagagatggtgctcaagtcaaaagcataggagctcacatagaaagcaaattctttagagatccttgattacaggaaaacaggccacaggtcatgttaaaccattaatttttggagctagccatgaagcttaatcaaattgatgttaaaacgattcttttaaggcattgactatccacgcattgattcttaggctctatttcatcatcataacttcctttacatttttatgataacaggaatagcaacattattatcatcattcatagtaacaaatgtttatatagtgtttagtgagtaccaaagtctaagctttttgcatttatgaacttatttaattctcataactcttataaactgggtgctattttttacctcatgtcattgaaatcaaataatttgccctaagtcactcagcaagtaagtggggatttatcatctcctgttcatcttgtaagctgttttctatttcaggaagcttaagaaatctcagttttattctgtgaaggctaattcatattattagcacatcaggaaaacctgttacaaacaaatattcagcagagacatagaaatcaagaactgtgttcctcatatcaagtgtatgatcaaggcaaactgggaactgcttttatatgactctctcccaatcacactgaattctatgattccttatcccatttccttcactaaggttatccttggggttgattcctgccaacttggggatctccttgaatgacatcctttctaattcctactgttagagtagatctagttagggaggacatttatgaagaaagacctctcccacaacaccttgaaaccgttgtagcttacttatcctgagtggacaggcatgggcttggagggtgaaggggtcttgcagttctaacatgttactcatgttctttcagtcatcttcttaaatatactttgtagaactatgaggccttatggagatcttaggagaagtactaatgaacatagaatttctgtttttaatcatacagtattccaattttcagttgccatatgtacatatatgtacacagacttgtgtgtggatgcatgcctgcttgtgaacatgtttgcctttgtgtacacacacagacacacgcctttgtgtacacacacagacacacacaaacacacacacctgcaaagatagtttgaggtaaccataatctttctgtggtaagcatctgaggtctttgtaaagaggagtgtactttccatttatggcatggcaaatacattaatcccaagaactctcaatatcaaggcccttttatggaaagtttcaagaagctttcctaggcccctctgctgacctaattatcggggtaatctgttttatcaccgtcaggtggagccaggatacttttaaatttgggataagggtcagatgtattaatccatatcccagagtatacaaattaactcttggccagctttatataaaataaagtacaaagtcaggttctcagataaggttggtatgttgtttggtctttctttttattctattcctgataaagattcacttgttgtaatccagttatctcactaattaactaatatttatattattaacacaacaaaaggaaaactggtggatatcacaggcctccacaggacaggcaagtgaatgaatcacttaagctggttaaggactgtagtgatctgtagagcatatactctgcctaaagagggcagccatgtcttaaaaatttccacacactagccttactagaatgtggactttatgctgccagagcttctgatttttcaagaaacgtttggaatccagatatttgtatgaaaactaatttttcaatgctagcagttaattctaatttttaaaatacgatgccatataatgaataaactattataggagttgacaatttttttctgtaaagggtcagttagtaaatagtttggactttgaggtctgtatggtctctgtttcaagttctcagttctgcagttgtaatatggaagcagctgtagacaataagctaatgaaaatggtgtgttccagtaatatttacaaaaacaggtaaaggcctattttggcccagtggtggtaagtttgccaacctctgaactaaaataagatgtatcaaacatgtgtaagtatcgaaacataatttgactaaacaaagtgagctgtagaaggattcaaacattttattaccatttggattaaatgtaaaaacctgctaaaaaatgcatttatgggtatgtgcatgtatttgaatgataaagattgaatttatgatagtggttgtctctggagagggaaggatgtgggtccagagaggaattgattacagtatttaatttctttataaaaaggatctgatggaaatacagcatgatattaaaatatgattagtacatgggtgtttgcttccccccacctttttgtctttatatttgaaatactttacgaataaaaaacattagtatgcaaggcaatcaaaacatgtctgcagacttaatttgactcagatgccatcattttgaacaacctctgctgttcatgcgtgcaagcattctaaggatatcagctttgtagaaaatgatgagtctttatgtcaacaagttggaatctactacccatatatttggaggttttcaatgcaataacagtttgtgataggtgatatgaatgataaccaagatgtaagctggttttcatcaacctatatcatttcttttatttctgtttacaaaatcaggcataacttcttgacaatgtacatatattataattactttttaatgaccttgttatctagcattcctcatagtatctttctgttccctctgaggtttctcagagttttatacagtgtcagcttgttcttattagatctaattatttcataatccaatttaccatttctactcatcatcgaagactttcctcagtactgtcctagaaaacctgcaaagcattgtacatttctaataatatgatcttccacaattattgtttttcctgtgccaagatcaaggatggcatacttttctgttgatctcaaactcatttagttacgagtcatgaaatgatccatatattgagctttattgaagggcagaggttttgttttgtttacttctgtatccttagcaccttgaaacagggcttggcacagaatagctactcaataaatttgtgttgagttaataaataaatgaatgccattattcttttcagaggatataattttacatggtttctggtggaatgtggtgttattccaaaggcagctttagacattgcagtggcagaaggaaactttcagaattctgagtttatgatttattaacttggagtttcaccctgtgttccctaagtttttacttcttacattaatataatttgatttctaagttcctgatgttttctttttactttttttcataaacgttaatgtctaaattccaactatggttccttttctcaactgaaacttatttgtgtgactatgcaaaccttctttatacttaatgcttattatctgtgctattgttttttcagtgttgttcttagtccttcactttctatcactgctaccctttatggtacaacatggcctagtcagttgagttaccaaaagattaaaaaggaaatcgtggtcgataatcccagcactcggggaggctaacgtgagaggattgcttgagcccaggagtttgagaccagactgggcaacatggcaaaacccggtctctaccaaaaaaataaaaaaattaaaaaaaataaccaggtgtggtggcattctcctgtacttgggaggctcccagctatttgggaggctgaggtgggaggattgcttaagcacaggaggtcaaggcttcagtgagctgtgatcatgccactgctctccaaactggttgacagaatgagaccccatctcaaaaaaagaaaagaaaagaaaattgtagctcttcctgaacaagtcctgaaatgtctttcccatatgcattgaggatcttcaagataacctcccagtttggtaatttgttaaaaggactcataggactcagcatatattgttactcagggctgtgatttattacagtcaaaggatacaacacaaaattagcaacgggaaaaggcacatagagcgatgttcagaggaaaccagacacaagcttccaggagttctctagtggagtcactcaggatgtacaaaattcctccagtattgcttgtgacagcacatatgaagtgttgtctaccgggggatattattaaattattaattggcacaggtttattgggggctagttatgaaggcaacctctgtccagcacatatgaaaatgctagacccccagaaggaatgcaggtattcagcataaaccacattgtacaggcattctaggcatagtgagtcatgttgtcagttctagtagtcactgtctcctcacttagccccattaacagctgtggatgggcctttgtcatcaccaaggtacccgtttcccaaagatgaagaaatttgatttcattttgttgtctcttggtgtcaaaaacataaaaacatttttcctctcctggacatcttcaactctaatgcctttaccaccaagcatagtttcaaacttctagggagcttctctctgtaactaattggaaaatttcttttctgacctcctaaccctgtatggaggttgttggttttatatttagtaaattattaaacagcaacatgttttttaaaacatttgtactgaggcctgacattgggtagtttctccctgcagtcaggttacttgtcagagatggggcatgactccaaagagaattaatgtatgtttttgttatctgaagtgcccttgggggttccagaatcctcctgaagagcccatgtttctttagcaaaagaggtttttcaagtctgaatccaggatacaggaactcaaatgaaaagcttgttctataggagtcttaaaatagaagataagaggctacaaataatgaaatcaaatttgtagaaactgagaaatttcaatcagatgtaacaaaaagatccttgctggagaatatataccagtagtagtacctaactctcatccaagttttttaagctatgtaatttccatttgaccacttattctttatagattgaatttgatcgtagattataatttaaataaaataaagcatagccacaattcgagtgctgactgcaacctatcctagcaaacctttcacacacataccatgtctgagatattctcaatattgttgcaaataatccctaatcacctgtgtcaacatcccagaggttaagtcaaacaaaagcagagaatagggaaatgtataacataatagattttatttgaggagtcctatttagagtgattgccagatccatatttttcacataatttcattccttaataactggtacttcgtcacaaattatcaagcagacgttgataagttatctgaagatttgatttcataagcttccacaataatgatgctgtttactaacagaatatccatcctatcccaacataaagcccgctgggaaaaaagtcattctttttaactagtaattacatgcttgtccctatctcactatacagtaatattttatttttagtctgtctccactacactgtatgttctttaagactttgaattattctttgtcttttacatttatataacacctatgtgagcatgctcgtaattttccagggtcatacagactgaaatattgctgcttttgtcctttgttaattccatctaaaacatggactaggcactcttaggtttcagtcatctgagtagatgtttaatcaacattcgagaaactatgtgggagaattaacggcaggtgatgatggtgggacttgaagcctgtttgccaggggccccggttgtgaacatcattttcagtactgtccagacacaggggcaactccctgtcatttgtgactctttccgtcttggctcttgcctctcttctttctttctttctttctttctttctttctttctttctttctttctttctttctttaattaacatcaccatcttttctgctattaaactgtcaccatcttgatcttctctccctcttttggcctttactttcccggccagagtgtacttctggtttcttttggagcatccaatctccataaatctcagcctttgacctctctgtctctctgtttctctctctttcactttctctctcttttgaaatagaatttacattttattaaaaccaaacaatccttgcaactctaaaaattgtatttttatggcaccttatgacttcattgttatttatcaaacttcaggtaatagctgattcaaaaagacttgaactataacttaaatattttgtgatttatgaaacttcttaaaacaacttaaagtttatatcttgtggccaaggtactatagacctagttgggaagggcctgcctaagtgaacataaacatcacatttcattgattctaagatacacttttccacattttaacatctcttaaattgggattcatcttatacttcatagtatctcacagtataattggtgaatctttttccttagtattataaaaatgataatgatgggacttataattaaaggcaacttagatttttactttttacttaagtagctgaggcttaagaaagtttacaaagtctgactggtaaccttcacacacagaagttttgtttgcatgtagtccttctcttctttcctgcccttgagatgggatttgttcccttgacctttaccccctttgtgggcaggaactggagtggctcatttcacccagcctgcagtctgtggatggccaagtgttaacagcccagtaaagggtcagagtgacaggctcctgcacctgccctttttgacactcaagttcttgtttggtgtccaggaagaatcaggtcacacaaaccatttgaagggtagtgtatgcagaggatttattgggcgataaaagtggctttcagcaggatggggaattggaaaggggatggtgtgggaagaaggtgatctttccctgaagcctcattgtctgaagttagctgcatctatcagtagtcttcgatgctcagccacatgtatccctgaggctcagcagcttgcatccccaaccacttgcatcagctgcttgtgttgctcttttttttttccctgccagctgatctagtttttatgggcactggatagggggcggggtaggacaaaaaggcaattatttgggtggaaaaatggggtcagctgttttcacttagggccaaggttccaggcttgagggtgaggtttagccgggagcccagcccttcaggggtcagctgttttcacttatggccaaggttccaggcttgagggtggggtttagccaggagcccagccattctgtatcaccctcaccaggttgcttcatgctgacctgcaagtggttctgcttatgctggcctctcatgagtctttcagttaaatctttattggatatgtactgtgtgctaagaattgtggtaactactggagagaaagatgagcaaaatcgtacatggtctttgcttttctgattatagactcttctaaaatagtgttaaccattagcattataaaatggcccaatcataggccagatcattctgttgttcctgtggtgtctagatttcttaatgtttccatgttacataaggaaggagccattctgggtgatcatttaggactctgtatccagtgaccctgtatgggtagagtaacagtttgggttgactacttgaaggtggtttacctccttcatgccttcatcatttacttctcagaggttttcttcatactgcctgtatccaatacgttgcatctgtttttgtcaaacttttcaatgaattatgtatagcaagtctaaatggagttgccttagggtttagtttccctctttactcagtgattatttgatacagctccagggaagattccactgggaatgtgtgtcagctggcacttgctcaagcctacagtgaagctgttatttcatttcttatgtttagttattcttaagaggttggtgtctgggttagagttttcttagtcccctacctgttttcttagcattcgctgctggaatctataaccaactccccaatggactgcaggtagccaacatgcactctcttggtagggccttgcccgcattgaactttgcatttgtttagtaaatttaattaattttgtatagattataaatgtacttagcacaaaatttaaaaagtacaaaaggtaaacaataaaaagaaagtctactttttacacctggctcccagccaccccattgccatcccaggaagcaaccatagttaccagtttctctagctccagtattttttaaaaataactttttattatgtaaaatcaaaaatgtatatggaagaggataatataaagaacctcctggtatccatcatgttgctccaacaattatcaaaaaataaccaatcttgtttaactctactcccacccactttcttggattattttgaagtggatttcatactaaaatcatatgatgtttcagacatcataactaaaagatagtgcctcttttaaaaaacatatagccataataccattttcacactaaaaagcaaaaataattccttaatatcattgcatttaaaatttttcaatgatgtattttcttttcttttacagtttggttgtttgaatcaggatccaaacaaggtccacacattgcattttgttaagtctcgagcctcttttaatctatagctcccctcacttttttttcatttatttgtggaaataactgagttgtttattctgtagaattattccgcgttcttctgattctgttaccaaatatagtctggtgactgttttttctatacattggtattttgatctagacgcttaatcagttgtaggtttaattttttggcaaaaatactttagaggtggtattcagttttaattttacagattaagccaggtaagttcctggttatttttcatttgtttgttttgttttgtttacaacatggtttttaagtacacgggctctatagtcagactatctgggtttgtattccagctccacaacttagtagctgtatgaccttgggcaagtcctatcaaactcactgcatttctccttatttgtagattgtggatcatagtagcatgtaattcatagtactgttgtgaggaataaccaaatccaatgtgtgtagagcattttgaacagtgtctgtctttgagtaggtattcagtgtacattaactattgtggtactatatttttatttctccattgtcttgtacggtatagccagggctgctgtattgttctacgccagggttcactgtttatcttgtaggcttttgaatgatactttttatggtgctgtacaatgagtagtccgtgtggccatatgtagcagcccatatagtcatacaatacatgaacttgtgttgttcagctcttttatgtttttcatagcactactattttataaacaggatttagtgtctatctggatttcttattcgcaaactcatatatcacattgcctttttgtttctgtacccctcttccttgaaatatacatgtgtttgtgcccatagatacacaccacatgcattttcaaagtcaaagctaaatagtattcctcttacaacctctcttccaactgagtgatgtgaagattatgtagtttatgctggtttccacttaacacatctatggagagttgaggctatcagccagctaccaacaaaaaggaagtgaatcgattagcagcatgcctggggactgtgtagacatgcccacaaacctcatgttgttatatgatctgtccttgggatctggccaaggttcttggtattttaatcaatatgagatagatatttccagaattaggaccccatggggtgacccatgataatctggacatcatttttgtcaagtttaatagtttctctgtgaaaaaaaataatattgtgtgtgtgtctcctccttagatctgacatagaaggcattcatggaaaagtatacctttctatgctgcacttgagaggtggtaggcctgtgcacaggggagaagagattaggtcattaataaaatggtactcatatcctttctaatttaataagtcaatataacttctacagatgtgacactagggaattaaataatacagaatcccgatttttaaagttttctaatgcacaactatttcactcatatgtacacatatacatacatacatgcccaactagccaaacaatatataattatagtaatcctttacaagatgtccgttctagtcttaatcaaaccagtagcaggtttagctcatggagtagtttagatggaatgtgcttaggaaggtctgacttcaaagagcctttagtcagagcccaagcaactttctcagctctctctgatgatttcatttttctcttggctaatatattttatccatcaatgtcaggttgggccagaaatacttgatttcgagatagaagtcattgttttttcaggttttcagaaaaataattacatttattattgtgtattatatatggggatagagacaggtacacatttgttaatctgtatcttccaaggtccccatattgttgactagagttggcagatgggtcacaagcccaacacgtctttacccaggctttttcaggtaaagaaatgcaagttcagattgctctttatatatgtgtttccaaagcagacatataaaatgctcctcataaatcaaccccttgtatttcctttcctatgatttaactcatgtttttgttgatacaggcacatttaatattataaccattcattgtataaaagattgctgttatgttttgctgatacagtgtaaattggcagagttggtcctggcaaatgcagaagtcactgtaacatcttggcccatcctgcctcatattgtatcagtcttcccatatgcacttcctcatattcataatacatatagtattcaagaactttatgtacagcaaaaatatttttacacatatttacttgtccatctaatttcttattcaaaatactataaccaacaaattcgtcactgtggtttaatcacaacacagaaacataccactgatactatatgccatggtttataataagcactttgtaaatttttgcttatttaaacctcacatcatgtttatgagttaggtgttattattattccattttacagatgaagaaagtaatgcacaaaatttaagtaaatttcagaaagtagaccctgaatttgaatttagatattttgacactaggccaagcgcggtggctcacgcctgtaatcccagcactttgggaggctgaggcgggcggatcacgaggtcaggagatcgagaccatcctggctaacacagtgaaaccccgtctctactaaaaatacaaaaaattagccaggcgtggtggtgggcacctgtagtcccagctactcgggaggctgaggcaggagaatggcatgaacttgggaggcggagcttgcagtgagccgagatcacgccactgcactccagcctgggtgacagtgcgagactccatctcaaaaacaaaaaaaaaaaaaaaaaaaaaaaagaaaagatattttgatactagtatctgtgctcttaaacactgccatttttactactaaaattgtgacttgttacacttgcctttgtttctttgttatacacacacacacacatatatttaataactttatatttaataatatttaatttgattaaaatttgaattaccatatgtagccagtagtggccctattggacagcacagattccagcacaacacgtaacttagggatgacactcaatacatatttgcttaaggaaggaatgactctcagatttatttttccagctcagatctttcccttgaccttcagacttatgtatgtaatttcttatttggcaccttcactgaatttctattagacattttcaaaccatctattagacagttccaaagacatttccaaatagttcatgtccaaaatgaactattgatctttctctccaagcatactccatccataagcttctccatttcagtttcttctactctctcagactaaaaacttttgtcatgtatgatttttgacagctaatctaccaacaaattctgtagggtcttatttcaaattatatacataatctgaccacttctagtcatctccaccagttttactaaaatttaagccacagccatttttgttccatgttattgaaatagaccttttatatgtctcttttctctgctgtcccagttacgctcttactgttgtctacacagcagctagactgttcttctgtattcaggccaagtcagagcagaccattcctctgtttaaaactcaccagtggtttctcatttcattcaaagtaaaagcaaaggtccttccaataacccaaaaggcctatataatagctcccgctcccctgtccaataccctattctctctcttggtctcatcatttttaatactctcccttctttattccactttactttcactggcttccttattgtttatttttttaagaaggcaaggtaaacaaatagcttaagtatttttatttgtttgcaactaagcttgttaacactatataatgaaaatgtgcaaagaataatgttgcagttttcggttagatttaagtcaaagatattcattaataaggaatcttcgaacgtgaatattccagaaatttctctaagccatctgatcagaacaactgtctctgagtattaccttactttgtaaggtattggcatgcatttgaattaaactcagattttttcaaaataagtcctgattaaaaaaactattctatattcaaactaaaagaatataaatagaacttttcctttccagaaacaataaaggaaacaaggcattttgtaaaatatggtcctgagcaagttgcagtaaaaaaataaatgtatacttctacctgctcaaaacagaggctactttcttttcctcagtcttggaaacaaggtgaagaacagcctaaatgtgacttcgggcaggcggttgccaaaacagctcaagcagttgaccatggacacctcaaatgaatttgggagaacctcaccaaaggatccaaattctatttttaataactgatacaaaggtgaagtggctcttcccaagtagcagtgctgccagggcctggccctggcccaggcccaggcccagctctgagcttacctgctatgctcccaagcaaaccatgatccttctgctccagggcagaccttttccctttagaggttcagtgtccagggagctctatgattgtgtgaatgaggtgagcgccgactccatgtgagtattttaaggcttggagtcaaagtatttttctaacacgcttaggcagagtccatgtgtcaatggcccatctccagtttgttctaatttctcaccacacatttgtagatatttctcaccacacatttgtagatctaggaccacagacctttgctgtattatcataatcacagctaatgtccatcctaacttatgattcatattctatgcctggaaacagtccctgtatttaacaataaaacctacacataaaaacaatccactgttgcaacttatatggtcacaaaacgtaaatgatcttctgtagaacaagcaattttttttttgttttttgtttttatttatttatttattctttgagacagagtctcactctgtcacccaggctggagtacaatggcgcgatcttggctcactgcaacctctgcctccctggttcaagtgattctcctgcctcagcctcctgagtagctggaactacaggtgcctgccaccatgcccagccaatttttgtatttttagtagagacgggatttcaccatattggctaggctggtctcaaacttctgacctcaggtgatccaagcacgtccgcctctcaaagtgctgggattacaagcgtgagccacagcgcccggccaagcaaatgtttttaaccataattgtcatgaatcaagctcagccagaatccccaagatcaaaaaaaaattgcactatacaaataataacttgaaatatacatacacacgctctcatacacacttcttacagaactgtgcttggggaagctccatttgttgagtgccactgaaggcatattttgctaaactgcttctccaagtattttgttttggaaaatctatcacagtagggcacagctgtttactggatgagcagaaaaagggagatatgcttgtggcaaccaaaaagttttaaggtctttcaagttgtataaaatggacctacagaaacgtttaagtgttctcaggatgcaaaattgaagctgaaatgtgttgtcaaaccagttgcaaaaagtgtacagcaggcatctcttgaggttaaacctggtacccagatacataacaaagcttcaggacacatggcttgttggccttgtcccataccgttgcataatctgatcatgtgtgaatttcacaaaagattcattcatattgttctgctagtttggtattgaggatttgctcatactcctcctgaatcttgtcttcatagtctaagacacactcacgtattattccgatttgtcagagggtaaatgtgggctggtccttcttcatccatgaggaacctggagagctaggtgctatgagtgctgaggagtgaggttgactttctgaagcacaagcttcactctgattaagaacaatttctaaatgtctccacctctgataacgactgtattctagttttatgttctgaaaaattttctccggaattgtaaggcgccgcttgctgccgagtggggcggactgctgcagagttggcggtagggtctgcgtctgaagcggcggcggcttggcgtccgggggcctgaggcccggagtggggctgggcagaggggtgcagcacggctgcttcggggaagcagggactcagcagctttgtaccgaagtccatgggccgcttcagcgtcgcctggttcgccaggtcgctgacgggccagggaccgggagcggactcgggtaagtgcggcccaagctccggctcctcagtggggctcgccagccaagccctattgtttctttttctttttttcttttttttttttttttgacacttagtatctcaacattttattattatttttttttaattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttgttgttcttgcgatagtttactgacaatgatggtttccaatttcatccatgtccctgcaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatcacgtatttcaaaataataagagctatctatgacaaacccacagccaatatcagactgaatgggcaaaaactgaattttcctctaatcgcctcattaaatgtatcccacagattttgatatgtagtgttttcatgatcatgttttaaagacattctgtgattttaatttgtatttctttctttaaagaattatttaagagaaagcttataattttccatgcggaatggacttaaaaagtgatttctagctttatcgtagtattattattagacaatgtttataacatgtcaactttatggaacttactgatgttttctttgtaacctaatatatgatcactttttgtgagtatttcatgtgcaactgagaagtatagtctctattaccgggacataaaatatgatatatatctgtaagattgttatttaagtcttctacatctttacttactgtttatccacttgatttgttgtttaatgaaaatgatgtgttaaagtttctttttagtgtgcttttatatacatcgcctgtatttttgctttataaaggtggtgtctgtattactttatgcacagatattcataattgccatatctttatttggagaatggcttttagcatttaaagtgttctttgtggctgggcacagtggcttatgcctgtaatcccggcactttgggaggccgaggtgggcggatcacttgaggccaggagttcaagaatagcctggcctacatggtgaaaccccgtctccactaaaaatacaaaaattagtggggtgtggtgggcacctgtagtcccagctactcgggaggctgaggcacgagaatcgcttgaacctgggaggcggaggttgcagtgagccgagattgcaccactgcactccagcctaggccacagagcaaaacgccctctcaataaataaataaataaataaataaataaataaataaataaataaaagtgttctttgtttaatttaatgctttttggcttgaaatctattttgtctgatattgattccatttgcctggtagacttttgaccattcctaaattttcctcttttgcttcacattcctttaaactcccagacttcacagggtatctctcccttattttttgccatcttctctcttacaaatgatacctttcaaagtctgccttttgacaactgcatagaaagctcttccccaaggctcgaatctaccagtttgtcattatttttacgctttgtgtggactttgtctttctggttgtgatttagattactcttaggctactagccccttcttttctcattaactctcctgtttcagcattgtccttgctccctggaaagacttgaagagggaatatgagtgatatcttgctgagatttctttttttttctacttacaatttaatagttaagtcttttattatgtgggtgttttctttctttttgttatgtgaagggcatggctttatgtacttttatgttgttctggtggctctatattgttttgtggaggatatgtttggaaattttgatttacatagtcaccattgtcttaacataatattttccatatggttaaaaatactttgtaaatattttaatggctatatactatgatacaaaaatataccaaatttttccaataatttccctctttagtatgttagttttttccttttatgtgatgacgtatttgtgcataagttaattccactacatactttgggtagatttgccaaaatataatttttgcctcaaggttataaatattattaataatcttgacatagtttgaatacagggagaatcaattggcatatggatttatattaagctgctaactagggtagcctccatccttttttcaggtagcaccttcctcttttacatatatatcatgagcctggcctgaaatagctagtaggtaccagtgtggctgtttctggtgtttacagccagcatctctgttgagtgatagaactttgtgccaatattagttattaagtatttggagatcttccacctccacagattataacatttgttattctgtggttggattttctttacttaggacacacacttgtgttatattcagcaataacaaaagaaccaatggcctttctttcagctgtcctttagtctggcatccctggattttataattgaagaagaggggtgatatttaagagcccaaaatacaactggcaagaccttaacttggagaaactaatcaatcctcacattagtcattactgcttttgtggcttatgtcagagcatgatgggcttatttctgctcacgctttctgttagtcacttgtttttcctctcacttgatctgttttatcaacttcagttaatcaaagctgggcttcctattcatgcaactagatttttctcagtaatattatattatctaccatttcctgaattaattgagacactctgacatgatctgtgtactttaggtaagccattgtaactttctatagttgttttgtttggtttgcctctgaatgtaaaaatagcattgtgtgagaacacatttgagagtggtggttagggtctttaccaatatattttctatgattatttttactttcaatcttattattcatcacattacatggtagatggcttagcaatatttagacagtaattccacaaaccactttcatcctagaatcacctttgagacattattatttttttaaatgcaaactgccaggcctcatcatggacccaatgaattaatctcttgcattgggatccagagatctgcattttaaacatctgcccaagtgactctcatgcagtttggtacctgactgtagacttatttttgagatgcaaagtttaatgcataccctaccaaatcatgaccccagtgcacctcttaagtggtcatctctgtgctagtttttagagcttgtcacccttgctgtatatacatggcatgctccagggtgcatttaaagcgttattttctacatatgtttagaagtcattccttaacccaataacctattaaaatccacttatgttttatttgtattatttagtggttttattttacattttatctcctccatgcacttgaaattgaatatgttgtttggttgtgaaatagagatctaacttatttttttcccaaatagttaattgtccatgttccattttttgaacaattctgctttttttccaccaatttaaaatgccgcttttattgtacattaagttcttacatttatacgatggtcttatcgtgagctttcattttttccactgacctaactattcttatactactatgaccatgccacataatcattttccttttgagtagcacaaaccttccataattattctgtttaaaaaatgtttcactcattttgctagtttattattccatgtaaactttagaattattttatcacattccagaaaattagcttgttggcattttgattacaattatactaaatctattaattaattggaatgaagttgacaacatgcaatatttagtctttctatccaggatcacaaaattttgtttttcatttacggaagtctttttgtgtgtgtaatacttttatttatattaattctgagacttaaataaatcactctcctctctctctctcccacacacatacagtgcaactgtttttttctattacaattttgaagtgtctgttactaatatataggatgcttatgatttttatatcttcattcactgaccaggaattttaacaggcttccttgttaatgttaaaaacattatcaataggtctaagcatggtggctcatgcttgtattcccagcactttgtgaagccaatgcgagaggatcgcctgagcccaggagttctagaccagcctgggcaacataatgagaccccatctctacaaaaattaaaaatacaaaaattgctgggcatggtggtgcgggcctatagtcctatctactcgggaggcagaggagggaagagcccttgagcccaggagtttgaggctgaagtgagccatgaccacaccattacactgcagcctgagtgacagagtgagaccctttctggaaaaaaaaaaaaagtatcagtaatttctcttgcatttttcagttagacagttatatgataggtaaataatgattattctatctcctttccaataggtttaacttttctgtttttgtttctttttaaaattacattgagaacccagttcctcaccacctttgctgttcattaaactcggtgaagagttttttaaaaagtatcaggactcacctgaatcagagattctggtttacctgatgtagggggaatgtgggtattgtcatttttaaaagcttctcagatgtttctagaagctgtgtttgagaatcattgttctagacactctgaccaaatgataagtagtactagtgatagcagacatccttttctggcttctgatcataagcttctagtattgcaccattaatggtgatatgagctgatcatttgagattgactcagtggtgtgttggaggcagctggtacctgctcaaaaggtgtaactgtacacatattttcccaacttcacattcattgacattatgttgatcacttcaaatcagccatggttgattcacatggaaattgacaaatgctaaaatcagcgctccccaccttctctgtcaacctgttcattatttgccagcacatcacagtagatctttattagcttaaagaagtattcttttttaaaaaaaagaaaaaaataagaagtattcttttattattaggctatgaataatttttgtccttcattatcatttgcatttcattgcaaccaccttttaatcacattgtcaccttatatcagccacgttctaaaaccttgtgtttctcactgtaaatgcttttttccagagggattcctgtattctgattcttcagagagttttccttctattaaactacattgacttttcctaaacctaataactctttttatggaggaaactttttttcttcttcatcttccctcctcctacccttcctgtcctctgatactcaccagtctactctctatcttcatgagatctacagacctaagaacctttttagtttgttcttttggttggtttatagacaagcaagagtcaaatttgagtttgtaagatatcagtgtgagttcttgcataaaaattccagatacaaatgagtaaaaaagtttaaaattcttctaataatcactgctgtggtgagccacggattcagaaggtagggtgtttgggtggaaaagagtggttcacagtgaccaacctagaggaaaagatggactgcatgttcttcaggcaatcctctatgaatactgtcttgtcacaaagatgtatgtaagaattacagactatggccgggcacagtggctcatgcctgtaatcccagcactttgggaggccaaggctggtggatcccttgaggtcaggagttcaagaccattctggccaatatggtgaaaccctgcctctactaaaaatacaaaaattagccaggtgtggtggcacgcacctgtaatcccagctactcaggaggctgaggcacgagaatcgcttgaacctggtaggcagaggttgcagtgagccgagattgcgccactgcactccagcctgggcaacagagtgagactctgtctcaaaaaaaaaaaattgaattgcagactataaatctggaattgccattctctgagaagtaattataatgtacaaatcaccatctagtcagataaatgtagaccaatatgctatacaatcaagctgaaattggagttgacagtgtcttgtgaatattagggatcctaaacagacacatggctaaattggtgtttattttcactgagaatggaacaggccttgggcagggccatgctttttctatacccagatttttgagggtttttatcctgaagggatattgaattttgtcaaatgctttttcagtaacaattgaaattatagtatggtttttgtccttcgttttattggtatgatgtactgtattgatttatttgtgtatgttgaaccatccttgcatccctgagataaatcccacttggtcatgatgaaggatttttaaaatttgttgaatttggcttgctagtattttgttgagggtatatatgtgtgtgtgtgtgtgtgtatgtatatatatatatatatatatatatattgatcagtggttatggccaatagctttttgtttgtttgttagtttgtttttttgatgtgttttggtctggttttggtatcagggtaatattggcctcgtagagtgagtttggaagtactccctcccccctctattttttcagaatagtttgaataggtttagtattagctcttctttaaatgtttggtagaattcagcagtaaagctattgggtcccagacttttctttgctgttagactttttattatgcctttgatcttgttccttgttattggtcggttcaggttttggatttattcctggttcaatcttggtaggttgtgtgtgtctaggaatttatcaatttcttctagttttccaatttattggcatatagttcctcatagtagccactaattaccctttgaatttctgcagtatcagttgtaatgtctcctttctcatctctgattttatttattgggatattctctctttttatcttaatctggctaaaggtttgtcaattttatgtatcttttcagaaaaccaactttttgttttattgatctttttgtattattatcatgtcaaattcattttatttctgctctgatcttaattatttcttctactaattttggatttggtttgctcttgcttttctagttctttaagatacatcattaggttatttatttgaagtttttctttttgatgtaggcattatagctataaccttccatcttagtactgcttttactgtatcccatacgttttagtatattacatttccattatcatttgctttaagaaaatgttcagttttcttcttaattttaccattggcccactgatcattcaggaggatattaatttccatgtgtttgtatagttttcaaaattcctcttcttattgatttctagcttttttttccattgtggtcagagaagatacttgatattatttcagtttttttgaatgttttaagacttgctttatgggtgggtgcagttgctcacgcctgtaatcctagcactttgggaggccgaagtgggcagatcgcttgagtccaggagttcaagaccagcctgggtaacatagtgaaaccctgtctctactaaaagtacaaaaagttatccaggtgtggtggcacacgcttgtagttccagctactagtgggggctgagatgggagggctgcttgaacctatgaggctgagactgcagtgagccactgcattccagcctgggtggtggagtgagaccttgtctcaaaaaaaaaagacttgttttgtgacctaacatatggtctgtccttgagaatgatccatgtgctgaggtgaagaatgtgtattctgtagccattggatgaaatgttctgtaaatatctactagatccatttggtccatagtgcagattaagtcgaatgcttctttgttgattttctgtctgggagatctgtttaatgctgaaagtaggggtgttgaagtgtttagctattatcctattgaaatctacctctccttttagctctaataatatttatatgtttgggtgctccagcattgggtgtattatatttaaaattgttatttcctcttgctaaattgacccctttatcgttatggggtcataatgatcttctgaagatttaaagtagtgaagggaaaaaaaaaacttttattctagaatagtatgtctagtggaaatgtccttcaaacatgaaagagaaataaagactttcctgacaaacaaaagctgagggatttcatcaatacgagatctgtcctacaagacagatgatcttctttgtctcttacagtttttgtcttgaagtctattttttctaatataggtatagctactctgttcttttttggtttccattggcatggagtatcttttttccacccttttattttcagtctatgtgtgtctttacaggataaatgtgttttttgtaggcaagagtcatttgatctatttttttttatccattcagctactgtatgtcttttgattagagagttttgtctatttatattcaatgttattattgataagtaatgatttactccgtcccattttattatttgttttctgattgttttgtggtcttgtcttccttcttttcttcctgtctttttagtgaagtagattttctctagtggtatgattttaatttcttcctttttattttttgtgtatccattgtatcttttttgatttgaggttattaagaggtttgcaaattctctcttataacccattattgtaaactgatgacaacttataactgatagcataaacaaacaaacaaggaaaaaaggaaactaataaaaactttacaccataattttttctgcccacttttcagttttttgttgtttccatttatgtcttgttgtactctctatgtctttaaagttgttggagttattatttttgattgattcattgtttagtctttctacttaagagtggtttacacattacagttacggtgttataatattctgtgtttttctgtgtacttactattaccagtgagttttatatcttcagatgatttcttagtgctcattactgttcttctctttctgaatgaagtactctctttagcgtctcttgtaagatagatctgctattgatgaaatctctcagcttttgtttgtcttggaaagtctttatttttccttcatgtttgaaggacattttcaccagatatactattctagggtaagagtttttcttcttcagcactttatgtcatgccactctctcttggcctgtaaggtttccactgaaaagtctgctgtcagacatattcgagctcctttttatgttacttgtctcttttccccttgctgcttttaggatcctttttttatccttgatcttgaggaatctgattattaaatgcctttagatattcttgtttgggttaaatgtctctggtgttctataaccgtcttgtacttcaaagttgatatcgctgatactatcccactgaataagcttgctacccctgtctctttctctacctcctctttaaggccagtaactcttatatatgcccttttgagactattttatagatcctgtagtcatgcttcgttgtttttcattcttttctcttttgtctcctctaaatgtgtattttcgaatagcctgtcttcaagctcatcaattcttctgcttgatcaattatgttattataagactctgatgcattcttctgcatgtcacttacattttttaactccagaatttctgcttgatttttaaaattatttcaatgtctttgttaaatgtatgtgatagaattctgaattccttttctatattatattgaatttatttgagttttctcaaaatagctattttgatttctctgtcttatatgtcacatacctctgtttctccaagattagtctctgatgccttatttagttcattttggaaggtcatattttcttgaatggtcctgatgcttgtgaatgttcatctgtttctgggcatctaagagttaagtagtgtagtctttttagtctgggcttgtttgtacttgtccttcttgggaagactttccagatatttgaaaggacttgagtgttttcatccaatccatatctgcattagagagcatcccatacccagtaattctgtggttcttgcagatttgtagcggtaccaccttgatggtgttgaataagatctggaagacttctctggattactaggcagagactcttgttttctttccttactttctccttttacttttaaagtccacttttacttttccctctacttttctgaagcagaaggagtctctccccacagctaccacagctgggaacgtgttgagtcatacctgaagcccacaaagtttcgtctaaggcccaatgagtactatctgggttttgcttctggttatttagggtccaaaggttctttagtcagcatgtgatgggtcctgccaggactgggttcttccattcaaggcagtgggttcccttttggccccaggtgtgtgtagaaatgtctgggagctagagtctggaaaaggggccttaggactctgatgagtgctctaggctactgtggctgagctaatatacaagatgcaagacaaagtcctctttactcttgccccctcttttcctcaagcagaaggaaggggtatcttttggagccttgagctgtgctgtgtggggtggtgcaaggactcccatagccaccatggctggtgtctcagtaggttgcatgcctcccaaattcactggctctgagcccagttcaacactaggactaatataagagttgcagtccttgtggcttagagtgcccttcaagtttatttagggatccagagcactttagcctgcagtgtcaaggcttagaactaggatgtgtgattcccctctagctagggctggtttaaatgctccctgtgtgggttgtccttagctgagttcagcctgattttgctttcttccatgtgacagggtagcacggagttcaatgcagtgtctcacaattgctgcactctctctttctgaagtgcacacattccagtgtctctttttttggagaaatgtttgctcatattttcttacccattttttacttgggttatttgttttcttgttatttagttgtttgagttacttctatattttggatatcagccccttatcagatttatggtttgccaatgtttttacccaatccgtgggttgtcccctcactgtgttaattgtttccatttctttgcagaagctttttagtttggtgcaattccatttgtctacgttagcatttgttgcttgtgtctttagagtctgatccaagaaatcattgcccagacaaatgtcatggagcttttcacctatgttttcttctagtagttttatggtttctggtcttacatttaagtctttattcattttgtgttgatttttgtatacagtgtaagatagagtccaatttccttccgtatgaggatatccagtttttccagcaccatttactgaatagagtatcctttccctgttgagtgttcttgacacctttgtcaaaaaatcaattaactctaagtacttgggtttacgtctggactttctgttctgtactattggttgattggtctgtttttatgccagtaccatgctgtttatatgtgattataataacttcataatatattttgaagtcagagaatgtgataccttcatgttttttccttttgctaaagattgctttgactattcagggtcttttgtcatttcatatgaattttatgattatcttctatttctgtgaaaaatgacattggaattttgataggaattgcattgaacccagagaaagctttgggaagtatggacattttaacaagattagttctcctaatccatgaacatggactattttttcatttatttgtgtcttcagtttgttttatcagtgttttatagtttttagtatagcagttattcacttccttgactaaatttattcctaagttttttctttatttaatactattgtaaatgggattgtttttgaaatttttttcaaatagttcattgttagtctgtagaaatgcgactgatagaggctaaacattactctgatgttcttgtttttgcctcctctgttatttttggtttggcctaaagacttaaatatcatctgagaagcacagttcttttagtcatatttccgtggttacatatgagcccagttgatacggtggtaaggtgtcatgggtggggaggtcttctataagattatgtctctgtcttttagtgagctgtgcccctggcctgtgacttacttaagttcttctcaggaattttttttccccctcttgggagagatgggaaggcaaattgggtctggaattcggtatttcccttcacctcgttcgcttaggttctgataaaactccaggaggttttgatctggtaaaaatagtttctcttgagggaagaccttgttaagaagaagagaagggtctgtgaatatttttaaatgactacttatctttcccccctgctggaagcatgaggggatttttcaccatcaaaacttgataggactcttgtaggtaaaactcacaaaagtttgggagccccttttggactgggccctattggagtttttacctctcaaatccgagcatattaagcctccagcaatttgtaaattacagattaggttatcctatcccagtgctggttcgcaaggagttttctactcctggccttctgttactgtaagatttggttctctctatctatctcctcacttctggggacagccatttaccctatgaccccagttatctgatgaatctaagaagagttgattttgtttgttcagttttttcttgttgtgtgaattggatagattactttcttatttcttatatggcagaccagaatgcagtcatgtttttgaaatatcaaagatttgcttcttctaaagttttgatctcttaaaaactacttagggtaatatactttgtttttcttttaaaagagggaaaatgtaagatttttttgatgattaacttttgttttttgtttacttttctcaaatagatcctaaatgcccaggagatgttgattttcataatagtgactgggacattaagacaatcaccagctccttgaaattctacctcaggtatgcctgatttgaattgggagtttgcttttcatagctggtgaaatttctctgggtgttgagcggagttaacgtggtctcagttccaggagtttggatagaattgcttaagaaaaaacatgtgaagaggatttctggccaagaatgtgcaaagactgttttttaaatctgagagtttaagcaagagaagcataaaaataatagaattgttactgaaaaaaggctaaaaagattatgttcaaaaaacatgcacttgaaataattgaatacgttttgctcttcacagatagagtgatgttgtgatggattcactagtagaatcaggagctgggactattcagggtggctaacatgttttagaggataataaccattttgaaatgtcaaattgcatttgggcaaaaatggtatatgtgtgtgatgtgctacgtatcatgtcttaatccaggtaatggaaataaaaaccaagaaaatacaactgtaataatattggagctaaatgaactgtcagcagtatggaaaaaagttagctcaccaacaaaatttgggaatgtgcaatattaatgaatatattgttcagtttattggcataaatttatattatgcaaaaggtgcttaagacatatatattttttaaacacattgatttcttaccactctttatgtctcatagtatgtatcatactttatgtgcaaaagcctcttcttttcaatgattgtgttcttgagccattaagattgatacataagttctgggaaatctcattaatctaaaatagattgggtttcagatattactgttaaatattttgctactgtagcatcatcttagagctttccataaacttgaatgttctttccaggaatatttctcctgcatctgctgataaagaaaagaactgttattggagggtttattctgtactaggctacggctagttgtttacactgatagtgtcattgtttttttctcccattaaccgagtgtactaggtggtacttgactcgttttgcagatgaggaaaccaaggtgcaccactttctccattaagtaatagccatggtcccagcttgtattttttaaatctcagtgtctctgacttataaggcccctggtactggggcatcttcttctcctgccccctactcccaggagctttggccttctttggatggcttggtaatttagtaaagacagagagcaatctgttacaaatactttaagaagacttgttgtgatgagaatagtgggaataagtgattctgtatctctagcttccttcaaaggagtctcaacattttcttagatttgtaaggccttccccacattgcattattcccagctcatcctataataggcagggtggcccttttcaaagatgagagggtcaagcctgaaagtgcgagtgggcggcacccccagtaagtgatatttgttctcgagactctcatccatggttctgtaatatataccagccagtaaataccctatagaattctcaaagatagctgtgttccaggacaggtctccacactctgttctaggtaactaaatcaccccttatctctaacctttccagagaagtcctctaaaaatcatcccttctctctcccctatttttatcctctctcattcaactggctctttttccgagtatgtaattatgctccagccacatacatctttaaatcagtaaatgattcagtaaaaatatcttgactgcttattctatgcccagtgtgatgttaagcactaggcaaacagttgtgtatagatatggtctctgaccttaaagaacttatagcctagtaaaggggacagtcagaagacaaataatcatacaaatgtaataaactctaataagtactctgaaggaaaggtataacgtgctatgaaggcatttaataggaagacgtcacccattttggtttaaactgaggtttgaactgtaagttggaatcaactaagtaggagttgggttccagacagagggaaatgaatacgcaaagacttgaggcaggagggaagaaggccccttcaacaaactacatgaatcagtatagggggagtattgagtgtagagagggagggagaggtatgtaagggccatatcattcatggctttaaaggatcttttaaaaattagggtctaaatttatcttaaaagtaatgggactatattgaaagattttaaacatgaggtgcatattgagatttgtattttgaaataaaaaaggatggagattagattacagtgatataaaatgggcagagatgtggaaatcagttagccggctatggctgtcgtccaggcaagagatgatgctcatgcttggactagggagtagcagtagatattcctagaagtaagcatattcaagagatttgggaagtacaattcatgaattggatatgaggattagggatagggagacaaaaaggtgacttccatgtttctggcccatacaaccaaatgatggtcatgcatttactgatttgagaaacacaagaagactaagtttgagggaggcaataagttggaatttggatatgtcgaatttgggtagctttgaagaaatcagggcacaatattaagcaggcaattgaatacataggtctgaaactcagtgatgagttcagggcttgaactaaaaaattggtgatcattgaccatatagatgatagttacagccaggaacttaaacaagattgcctaatgagatactttactcggtgaggactaaactctgatttttcatcttgcccaaattcctttctaaggggtctggggagtcatgccctccaagccataaattctcatcagatgggttttatttaaccttgtatatcatgacttactttccaatctgactctggcataacaagggagaaaatgaaaatgttttatcccaaaatatattttcttgccataccttgaaattgccctgcaaagtctcttgtgggaaaaatccacattctatagagaatccccttcccccattgttttccttcatttctttccagatccaggagataatcaactaagagccaggtgcccttttaggtctaataagaaacattttacaacgtactctctctaaagtctggtatctgagagattcctccacacaataaaacttggtctccacaatcctttatcttaacctgaacattcctttccattgatcccggtcgtcagataaactcaaccaattgtcaaccagaaaatgtttaaatttacctatagcctggaagcccccactttgagttgtcctgcctttctgaaccaaaccaatgtatttcttaaatgtatttgattgatgtctcatgcctccctaaaaatatgtaaaaccaagctgtaccctgaccaccttgggcacaagttctcaggacctcctgagggctgtgtcacaggccatggtcactcatagttggctcagaataaatctcttaaaatattgtacacagtttcactctttttgtcaacatcagccaagcttctgtgtcaagtaatatacactcctggtctgtacttcttaactccccagttccttcttaactcattgtaatctaactcttaccccctctgctccaatgaagctgcttttgccagggtcaccagggataccctcaatgctgcacacaaagcacagttgtcagtctttaccttacttgacctttttgtaacatttgaagttgttaacaagccttctttgatactttcttctgttttggattctgctgaatcacttgctttttgtttttctctaacctctttggtcattttagtcaatctcctttatgggctttctatttggtattttcctgggctctctgctcattttactatagtagaacaactgaaaactgaaatatctacagggaccaggaaataaaactgaatgaagtagactattttcatattaaacactttgcacattgaacctttatttgtatgacaagccctttgtttacatacaaacagcagtgttgtttacttctacaaagaaccaatagagccagatctttgcatttttcaacagggacaggggatatgggtttgtatatgaaatatctcattttaaaatattttgatcattgattcaattccatttcacttttatacactgtgctggacaaagaagaaatatcggaagacctcatgtagctgtttgactgccagtttgccagctcccctggagaagtggcatctgttcttgtggtttcgtcatctgttctctaggttcctgattttcacatctgcttctctgatctagcagagccctgcatccagcttcttagtagatatcaccttcctgaggcctccctgacttagcatctctacttccctcttaatcaactcttattctattcactcacccaaaccaaactgctcccttgccatcatacccaatcaaagaaggagttctttctttaatatttttcaaaacagtctcctcacctattctttctatgctttgtcacccaggctggagtgcagtgttgtgatcatgactcattgcaggcttgccctcccgccacacccttctctctctcaggctgaagcagtcctcccatctcagccccttgagtagtctggactacaggcacgcaccaccatgcccagctactgtttttaagttatttttaagaggtaggggtctcattcagttgtccagactggtctcgaactcttgggcttaagtgatcctcctgccttggcctcccaaagtgctgggattacagatgtcagccaccatgactagcccctctgtttgtcttttattatcttttgcttggattactacagtaacaacagtggcaggcagtatagtatagtaattaagagcatggactcaggagacagacttcctgcttctgccacttattagctgtgtaattttggatgagtttttaacttctctaggcctcagtttcctcatcgatgaactggaaatggtacctacctcacagagttgttatgaggtttaaatgggttaatacatgtaaatcacttagagcagtacagagtttgctattcttataattattagttgattacttacttcctctgagccacctaccatatacctttattttgtcatcgtacttgtcccactgcattgcaaattttgtgtatggtgctcttttctactaaactattagctcgttggaggtttggactatttctattcatctctggatccccagtacctggcacaatgccaggtacaagtaaatgctcagccaatgtttttttttttctttttttttttattattattatactttaagttttagggtacatgtgcacaatgtgcaggttagttacatatgtatacttgtgccatgctggtgtgctgcacccattaactcgtcatttaacattaggtatatctcctaatgctatccctcccccctccccccaccccgcaacagtccccagagtgtgatgttccccttcctgtgtccatgtgttctcattgttcaattcccatctatgagtgagaacatgcggtgtttggttttttgtccttgcgatagtttactgagaatgttttttgactaaatgagtaaacccatttgagcctgagtttcctcctcccgtaaatggggatttgaataactgctccacctcacaggattattgggaggacaattgcaaaagcacttcggaaattctaaggatctatcaaatcgtaagggattcatggtagcattcagcatgggtcccctctggaattttgcaggactggtttgtgcctctttttacttctgggagctagttggagaccttgctagagggctcagcccatgcttttgcaggtcttttgttgaattactagcaacttggattccctgacgaagcttcaggtgaagagaaaaatgtatataatcccactaagctgtagggctcaggaacttcagccttgctgtccccagaactaagaatccaatacccagctgctttcttcccaaagcaactgacaattttcattcatttcaggaatctttctgaacctgtcatgacctatagacttcacaaagagctggtctctgctgccagtaagtatttatgttactaattaactgtgttgtcctagtttcttaatgtttactgcaataagcctagaaaattgtttgaggggaagtgattgagggcacagaaacctaaaacacatacacaaattatgcacaactgccaaatgaaagtattcttgcttgctgtctaactcaagagttctattatttttcataattagtgttacttaagtgggcttgagaaaattggttaacttgagggttgtgtgaatataaaggctttatttatatatgtattcattgcctcttccatcagaacaagaacattggctcacattaccaggggacagaaaaatggttacacgacagttgccgtttcaacttccttcagcattttgcctgttcaaatgcttttcgactgtgttgtgaaccattgtccttaatctgttagtgccagcatcacattttctagatgagaaaactgagggagagggcgtcagtacataggaaataaggcatagagaatcactcccaaaagttggcgattaaagaagcattgaaagttttggctgaggccactgtatgagtgcccctctccacctcaatgtgacccttattctgcatcatatcctgtgtggtgtagaggaaaaagattcaggggacttaacatcataatgcgtctttgttgaaacaagggagctttgttctttacttctgggctctctcagtgattttaacaggaatccagaggcagcagcacacttctcagtaccacaaggaaggtggatgggaataggtttccagctggaagtttatctgtgagacttcaggaacaacctgctgtgctcagagttctgactccctctgagacagtcttctcttctcatccttctcttttctatcttctattttctacatctttttagacctgtttctttgtgtgtgttttttttctctttttctgccttttttctttctttatgtctttgtctttgtttctgggtctctaatttttattgtatttcagtgcctatttatctctctgtctcttttcatctcattgattatctctctctctgtgtgtgtctctgggtgtctttctccgaatctctctctgtgtgtgtgtgtgtgtgtgtgtgtgtgcatgtgtgcatgtgtgtgtgtttgtgcatatatatgtgagaattttgctcaatccagttgcccagaaagccaaaccatttatctcttactgttctatcccagagtctgacaacctggattaccgcctaggagctattcactccctggtatataagctaccagaaaagaaccgagagatgctggaacttctgataagacacttggtcaagtaagtaactgctggattttcagaaaaagttcctattagaggactggcccatgtggttggactacacagaaactgcctctcagctctttcagccccagcccttaagtgcttccttggaagctgaatgctctgtgaggaaggctattttgccttgacccatgtacatatcctcttagagtcatcatgcatgtggattgtctcagttgaaaggtagcagcaaggtagagtggggtggacacaggctttgctgtcagatgagcctggttttgaattgaagctctccaacttatttgctgtataatctcaggcaaacctctctgagtctgtttggtcatctgcacaatccctacaatgaaggccagttgtgtggattaggatgaacacaggtaaaatgcatgtcacatgagaggctctcaagaaatggcactttttgttaagattctggtcaacttcttgccatggtgtggctggcagtaacagacagcgggatcctggagaatagtcctggtgacaggcactgagataggcaggtgaaaggggcacttgtgtcccacagtggtgcttcctggccagaagatttaatattgtgaatcaagatgaatttacttggcttaaaaaaggcggaaagcattctgtccaggagccagcagacctgggctctagtttcatttctgctttctgctattagttcattttgtgaccagggacaggtcactcttgaggcctctcttggtatatatattaaaaaattgtaatgtattttaagtgtatatatttagcaagtgcagttgtctgcatactcaaaagatgcagtaatgatacattttaacctcatttggagaggctctgaaacacctaaaattgaggcctttaatgaaggtgagtttccaggttaatggctcttttggcctccccctgtaataaatcctgagtgctttgcctatctggacctcgagttttcctattatatgtgagatctccaagatctgattcagctctgactttcaaagactgttttctacacttctatagcaaatgaatattgtggacactgatgtaggtaataagcagaattaacaagagagaatggcttttatatttattgccagtgtttgcaatttgagctaatagagaacattaagaggcatgtggtctccaaaaagtagtttgtgatcatctcagtaaatgtacaaaaatcagcaaagaagctatttgcatgttaatttaaagttgccctggaggagtctttgagtccaagttccagatctgtcacaaatatgctgtgtgacctagagaaagttcctcccactctctgggccacaggtttgtgcatctataacacgaagagactgaagcagctaatctcaaagggttttctcagctctgactttctgagagtctcaacatgtgacgagacccaaggactcaattgaggatgcccgtgcttagtgagcatcagggtgcctgcctctatctgcccaaaggctggctgcttggcttactttaagaatcttagtcctcaaaatcttgaaatcaaaagaagacatgaacaaatagatcacagaaatagaatggcaaatactcttaagtatgtggtaatatgctcaagctcactcatagtaacaaaaatacaaattaaacctatactgagctaccatttattgtcaaatcctaatgcttattaattagactatggggaaactgtcctctaatacatttattgtattaatgcagtacagttccagaagaggggatttggcagtacctaacaaatctacacattcagttatcctttgacccagcaaaacagcgtaaaacagggtatatgatatgttagctttttttttaaggcgtatactctaaagatacacctccaccaatacaaacaacacatgcacaagatttctcattgcagcacaattttcaaaagcaaaagattggaaacaacacaagtatctgaaaataggggactagtcgagtaaataagggtgtattcaacagtgtagtattatgcagtaatttaagaaaagaatgaggaagatctctatgaactttgttttgtggtgattttctgggatatattacaattttccagcacgtaaaacaaacatcataaaaaatctctggctgtaaaacaaggtttataatatgctagcttttcttttgtaagaaaaaagaggaaaataagaatatgtaagaatacacacacatttaaaaaaatttgtcaaatgaagcatacactaagataaatttaaaaaaaactaatgactccaaaagttaaatgtagagttgccatagatccagcaactccactcctaggtatatacctaagataaatgaaaacatgtctccacacaaaatcttgtacacaaatgtccatagcagcattatttcatagttgttgaaaagtggaaacaacccaaatgtctgttaactaatgaataggtaaacaaaatgtgatatacaggcaatggaatattattcagccataaaaaaggatgaagtactgatacatgccacaacatggataaacactaaaagcattatgctaagtgaaaaaaaacaagacacaaaagtacatattttatatgatttcattgatatgaaatgttcagagtagacaaatctatagagaaagaaagtagatgagtggttggcaaggtctgggaagtgggggtatgagaagtaatggggagtaattgataatgagtatgaggtttctttttggaatgatgaaaatttctggaattatataaggggtgacagttgcacggctccgtgaatatactaaaaaccacttaattataacctttaaaaaggtgaattttctgatatgtaaaatatatttcaataaatgtattataaaaataaactaatgaaagtggttattatactggataggtgtggtaagtagggtggaggtgataggggtaagagctagattcctctaagtatacctccttatatacttatgactattaagccatattaatgttttacatatccaaaaaagaaaattaaatcaaaaattataaaccgtaaaactgaacaccaataaaagcaaatgactttaatgaacctaagtgtttatcaacttgatagcataattacagagagaaagcaattatttcaactaacgtgtcaacacagtcctctgactcatccttaatgagatgtactctagaaacaagaagagcaaaattttaagcaacactcagtaggtttattaatagtagtaatataatttaacttgaaacaaacacacagatcttataaagataaagcaaaaaagtaaatatgttaatgttatcacaagctaagtttatagtgtacaaaagagatactgataaaaaagacataaggaaaaaaaattttaacattaaaattaaattaagaatgttaatatgaattcatgatttaaagagaaagcaacaagaagaaaaaactttatccactgaaacagtgtcgaagggattctacccaaaaagaagtgaatacacttagtgcccagttttttgtttttaaatagcatttccttttcaaaggaatcaggggtgcttagagaaatggctgattgcatgtctggagcaaggaaaatacaaagttagtcttggataaatagtaccaccaagcaagaaagaacagagtcacactaatagtgtcatgtccaaaggacgtagaaaccttgaaagggctgacactgatgatgtttgagccaacctgaacatcaataacaataaataatgtatttgattattacatgttgaaaaacaaaactcctggaggtgggtagaggaaggaaatctctttattgcagaaggaataccagctaataaacataggaggaatgacagaattagaaaaatcattagtttgcaatctaagtgatctgttttagacatgaatcaaaactattgggcaagagtattgaggaataggatgttcacattattccagtgtattactgacaagttacttactaatcacaaataaaaaacaatgtatctttacaatgaacctatctggcagacaccaccttaagtaattgatcaaagttagcatcagtaataacggaacaggccaagtgcagtggctcaggcctgtaatcctagcactttgggaggccgaggcgggtggatcacctgaggtaacgagttcgagaccagcctggccaacatggtgaaactccgtctccacaaaaacacaaaaattagctgagcatgatggtggatgcctgtaatcccaactactctggaggctgaggtgggagaattgcttgaacctgggaggcagaggttgcagtgagccgagattgtgccattgtaaataatggaacaaaccaccttatgtacctcctaattagacataataaaaattataaaacattaactgtgaaatatttttgccaaaaatacgtagcctgaatcaaattaattctttccaatttgcaggaaataaagagtatagaaaaacacacagtatttgacagtctataaagcttttgaaaaggcttggacttttcaaaaagtcaatgttgtgggaaaaagtggtagaggtactgttctacataaagagactaaagaaacaaacaaatacagtataagagctttgtttggatccaaatttgaaaaacgcagctataaaagactttttctcccataacatttgagaaaatttgaatatggactagatattagatgatatagaatctacgttttctaagatgcaaacatgttattgtggttttgtaggaaaatgtgcttattctttgatgatgaatgctgaagtatttagggttgaagcaatgtactttcagaggattaagaaaaaatatagacagaataaaagcaaatatggcaatatgttaatttttgagtctaggtatagacagtatgagtcttcctagtaccactctttcaactgttttgtatgtttgaaaatgtttataatgaaaattgtagggaaatgtaaataaaaaataggcttagtttcaatagagaaatttacacaggagaagaaaattcaagtgtttttaaaatgcacataattatcttgcctgtcaactgctgctttcatcatctatatgatgagtacatctatgcctttgtactgtgtttccactgacagcctgttttctaggctaataacaggcagaaccaaactgaccttagccaatttgaggttctcagttatccagttctttttggttagtatctgtagcttctattagtcagaagtaggagaactctaaggccacctccctggcaatcttactaccagtggaatattacaatggaagcaagctccaggcctaattctgccattcttatagctatttatcagcaggcagacgaaaaaagacttgaacaacctgttctgcaaactcaaatgaagtcccagctctctgtcctttcagatgccctgcctgacaacatcttggatgaaaggttcactggaggcagataagattggagtcagacaataaaatcctaccatctagtacccctatgtaaccttaggcctgggctaccattctgaagggtatgggttattagcttactaggttctttttacttttgtaataatacttctcttatttgagaagcaatactgtgcattgtataaattagaaaatttttaaaaagcaaaaaaaaaaaaaaaaaggaaaagctttctattcccaacattcaataatcattactgttaatatagttcaggttttttcggatctctctctctctctctctcttctctctctctctccctctttttctctctctcgttgtgtgtgtgtgtgcatgcatttttgtatacacatacctgtttgcatttttttttaccaaaatgagattatgctgttctttagtctactttttccattttaacaattttgacttttccagaccatattaactttttcccatttgacccaaaagtggccttttataggtgtttgtccaatctggtattcaatataggaacacattttatttatgtccttattgtgtttttaatctagcacagtgcttgtttctattattattattattatactttaagttctgggatacatgtgcagaacgtgcaggtttgttacataggtatacccgtgccatggtggtttgctgcacccatcaacccatcatctacattaggtatttctcctaatgctgtccatcccctagccccccaccccccgacaggccccagtgtgtgatgttcccctccctgtgtccatgtgttctcactgttcaactcccacttatgagtgaaaacatgtggtgtttggttttctgttcctatgttagttttctgagaatgatggtttccagcttcatccatgtccctgcaaaggacatgatctcatccttttttatggctgcgtagtattccatggtgtatatgtgccacattttctttatccagtttatcactgatgggcatttgtgttggttccaaatctttgctattgtgaatagtgctgcaataaacatacgtgtacatgtgtctttatagtagaatgatgtataatcctttgggtatatactcagtaatgagattaccaggtcaaatggtatttcaggttctagatccttgaggaatcaccacactgtcttccacaatggttgaattaatttatgctcccaccgacagagtaaaagcattcatatttctccacatcctctccagcatctgttgtttcctgactttttaatgactgccattctaactggcgtgagatggtatctcattgcagttttgatttgcatttctctaatgactaatgatgatgagctttctttcatatgtttcttggcctcataaatgtgttcttttgaaaagtgtctgttcatttccctcgcccactttttgatggggttgtttgtttttttcttgtaaatttaagttccttgtagattctggatattagccctttatcatatggatagattgcaaaaattttctcccattctgtaggttgcctgtccactctgatgatagtttcttttgctgtgcagaatctctttagtttaattagatcccctttgtcaattttgacttttgttgccattgcttttgctgttttagtcatgaagtcattgcgcatgcctatgtcctgaatggtattgcctatgtttttatctagggtttttatggttttacgtcttacatttaagtctttaatccaccttgtgttaactataaggtctaaggaaggggtccagtttcagttttctgcatatggcaaaccagttttcccaacaccatttattacatagggaatcctttccctattgcttgtttttggcaggtttgtcaaagatcagatggttgtagatgtgtggtgttatttctgaggcctctgttctattccattggtctatatatctgttttggtaccaggacaatgctgttttggttattgtagccttgtggtatagtttgatgtcaggtagcatgatgcctccagctttgttatttttgcttaggattgtcttggctatatgggctcttttttggttccatatgaaatttaaagtagttgtttctaattatgtgaagaaagtcaatggtagcttgatggggatagcattgaatctacaaattactttgggcagtaaggccattttcatgatattgattcttccaatccatgagcatggaatgtttttccatttgtttgtgtcttctcttatttccttgagtggcagtttgtagttctccttgaagaggcccttcacgtcccttgcatgttgtattcctaggtattttattctctttgtagcagtcgtgaatgagagttcactcatgatttggctttctgttattggtgtataggaatgcttgtgatttttgcacattgattttgttttctgagactttgctgaatttgcttatcagcttaaggagattttgggctgagaccatggggttttctaaatatacaatcatgtcatatgcaaacagagacaatttgacttcctctcttcctgtttgaataccctttatttctttctcttgcctgattgccctggccagaacttccaatactatgttgaataggagtggtgagagagggcatccttgtcttgtgcctattttcaaagggaatgcttccagcttttgcccattcaatataatattggctgtgggtttgtcataaatagctcttactattttgagatacgttccatcaacacctagtttattgagaggttttagcatggagggtgttgaattttatcaaaagccttttctgcatctattgagataatcctgtggtttttgtcattggttctgtttctgtttctctttcccgatttccctggacagaacttccaatactatgttgaataggagtggtgagagagggcatgcttgtcttgtggcggtttttaaagggaatgcttccagcttttgcccattcactatcatattgcctgttgatttgtcataaatatctcttattattttgagatatgttccatcaatacttagtttattgagagtttttagcatgaagtgattttcaaatttatcaaaggccctttctgcatctattgagataattatgtggtttttgtcattggttctgtttatgtgatggattacatttattgatttgcatatgttgaaccacccttgcatcccagggatgaagccaacttgatcgtggtggataagctttttgatgcactgcaggattcggtttgccagtattttattgaggatttccgcatcaatgttcatcagggatattggcctgaaagtttttgttgttgttgtgtcttctgccaggttttggtatcaggatgattctggcctcacaaaatgagttagggaggattccctctttttctattgtttggaatagttttggaaggaatggtagcagctcctctttgtacctctggtagaacttggctgtgaatccgtctggtcctggggtttttttggtgggtaggctatcaatttctgcctcaatttcagaacttgttattggtctattcagggatacaacttcttcctggtttagtcttgggagggtgtaggtgtctaggaatttatccatttcttctagattttctagtttatttgtgtagaggtatttatagtattctctgatggtagtttatatttctgtggtatcagtggtgatatcccctttatcattttttattgtgtctatttgatttttctctcttttcttctttattagtctggctagcagtctatctgtttagttaatcttttcaaaaaccagctcctggattcattgattttttttaatgcattttttgtgtctctatctttttcagttctgctctgatcttagttatttcttgtgttctgctagcttttcagtttgtttgctcttgcttctgtagttcttttaattgtgatgttagtgtttcgattttgtatctttcccgctttctcctgtggacatttaatgctataaatttccctgcgaatactgctttagctgtgtcccagagattctggaattttgtgtctttgttctcattggtttcaaaggacttatttatttctgccttaattttgttatttacccagtagtcacccaggagcaggctgttcactttccatgtagttgtgtggttttgagtgagtttgttaatcctgagttctaatttgattgcactgtggtctgagagactgtttgttatgatttctgttattttgcatttgctgaggagtgttttggcagtacatatactaaaattggaacgatacagagaagattagcatggcccctgcccagtgcctttttttatgatactgttttaccaacaagagaagaccaattgtcctgtagaatgttacttcctagttttgtctgctttcttctttgtcatatatttcagctaattactctacttcttgtatgttttgtaaagtagaggttatatctaaaggctagatggattccagttaactatttgttggctggaacaaatcacatgtgatgttgtatacaccatatgctgcatcacatctgaagatgcataagattggttgattcaccttactgatgttaagattaaccattgctatatttttctaccctgtcaatgcagggctgagagtgtctgtacaatattttcagctagtccatatgtctttaatacatctaggcaatgataattcatttttaccttatgttatgctcattaacaaagcctttggtgttggttggagataatgttagctgaaacttacaggagcccctctgacttttacctgagtctttaaatactcattaatcacccctagagtatgcgtgtattcacaattagaatactacaattataactaatacgttatacatgttagagtatacatgaaaactaacaagcacataaaccaaatttcatcagttctaataacactttttctcaaattgtaatctgaattctgtacacatctgaaaatcaatggtttcttaaaattacacttatcaggcagcagttttgatgtaattatcatggcctccatatgcatgaacttgtaatagctgctcatattatagtcacttaagttaaattatgttcattgttgagtttattttctatttaaaatgtcttcaaaaatattacatgatgatatgacaatgaaattacttttctttcttagtggtacataaataatgtgctcgtaactgatgactgatgaaattcatgacatcgtatggactttgttgaagtatttaaagtaaatgacagataatataacaccagtggaggaagccaaagctgtcagccctttaaaaaaaggcaccatttcgctgggcacggtggctcacgcctgtaatcccagcactttggaaggccgaggcgggcggatcacgaggtcaggagattgagaccatcctggctaacatggtgaaaccccatctctactaaaagtacaaaaaattagccgggcatggtggcgggcacctgtagtcccagctactcgggaggctgaggcaggagaatggcatgaacccgggaggcggaggttgcagtgagccgagatcgcgccactgcactccagcctgggtgaccgagtgagactccatctcaaaaataaataaataaataaataaaaataaaaaataaaaaaaaggcaccatccttggggatagggacctgtttgcttgtgacactgattcactctcgccttcactattgtcttttccttttgaagaattttttattatgtaagatttcaagtatatatgaaaatagaagaaacagtatagggaagtattatgtgtccatcacccctccttcaactgtaatcaacacatggccaatcttgtttcatctatttccccacccatttcccctcctcccatgttattttgaatcaaatctaagacatcatattatttcatccacaaatatttcagtttgtcttgaaaagattagaactgtttataaacataacatcacatctaaaaagaaatgagtaataatgtaataatattatccattattctgtgttcagatttctgcttcctttttagttttgtgtttctggggtgtgtgtgtgtgtatgtgtgtgtgcgtgtgtgtgcgtgtatgtatgtatgtatagggtgggaaaggcaagcatacttaatagatggttctatgttcttctaacaggggacacacagtgtgtggttgtctttgcccccaattattttcgagagcactactttctgagattcacttaattgtcagagctggaagtccccttagatcacctaataacttcattttacagatgagggaacagatacctaaggatggaaaaagataggcccagagacacaatactttagtaaaagaaccaaaaaatattgaaggtagcttccttgtttaggagtcagagggcacacagttcttagaattgttggatgctaaagctgggcgagacctaaaagttcatacagatagcctctcattctgccagaggtctcagtctggcaatctgttgacaaggtccagaccagaaatatattttatttgtcctgcagtgttttgggaaaaaagtgatttggcttcaacatttaaaaaatccagatagttcacatcaaaatatacatttcaggaaaaaaagaggatgttagcacactggatctgcatgcccacgtggcagcaatcagttggggttgagtaatggtttcttgctttggaatgggcacaagcttctaatttgccatagccctcaccactcccaagtgttttaacaaatattatattagagttacattagatgtgacctaggaatttccctttcttaaaactagaagttattctgttgatggtgtgtctctaagtgagtggcgggaaaatggtggtctaaagaatgtctgcttgtttaaatgtggcagccacttctcaccaggcccatttctctcatgtaagttacctgccttgcccctctagacatttaaatttatgacctctaatctaaaccatgcaatcagaatcattttattctgtactggaggcttctcacaaccaacctcagtggactagagagttcaagattcctttgctgtcaaataacatcacatactcttgtttttggtttcattcatcttgttaacccacaatttggaatgttacttatcccccatactgattttcaaaatatataataaaaagagagacactaaatgcaaagcaatttccccaaagaataggtgaacttccaaatctcataagaaggccaagaaggaagagtatcctaaatgggatgccaagtaactccctcagagaatcagaaggtggctttagcttagaagagctcacatatgagttttgatttctccagaaaagttagacaagcaggcagtgggatgcaatgggataactataagacttggggagcaacaaatatgggcttgaatctctgccttgccatatgaccttgccaagtgctttgctcttggtaaacctaggcttcaaagctaaaatactctgctttttggagttgtgatgattctgtgagctgctgggacactgaacaaagatcagttcctttcaaagttcacaaaaggagatacacaagtgcccttgtggtttagccttttagggtcacttggtgttagcatggagatacttttccattttaatatctgaaaaaaacttccgtcactaaagaataaagattaattgcaggggtattgaaactgttaaaaggaacacatcaccagcccagcaatatcaaaagctatgaatggttgctgttcatttccatctgaatggtactcagctttgtctagggcttaacagacttcacattaagatttgtctaaggattctgtcctcctcaattacccactcagtgttaagaacctgccattctcttctgggccttagccttggtaggtgtggagagtgagtgtttcgggtagtcagttgggctgttcctacagccaaactgaccaaaagagattcttgccttttacttggctgcctccaggactgtttgaaacagcactagggagctcaattcctttacaaataattcattagtacctgctgtgtggcaggcacacacacttggaagttgtttatcatttagtaggagaggcagataagtaaacggaaaattgcaacttactctgcttgccagtggttttagttaagatgagcacagtgggctctggtctccctgaaggagatgtaacgttatgtgcatctccaaggatagatagacattttgtagatgtagggagaggggggatattccaggtagagagaacgacatgagcagagaggtatgggggtctgaaacaatgtggtataaccagacaaccccaatctaagcagtttagtataacaagagtgtcagaggtcagcagtacctgaaggctcctggagaggtaataataacaacagatacttcccagggtgccaggtaccatgctgaagcaatttatctttatttattcaacaactctctgaagtgggtgctattttcccaggtgggaaaactgaagttcagagaggttagagtgagtgaactcactgttgcgcagctggtaagtggccgtgttgggattcaaacccagcttcagagcctaagcagtgagtagggattggaaataggggtcaagttactcaagttatggaaggcctcatttgtcactttgaagagaattggccctatcccaaagtaggaagccactaaagggaatttaagcaatgaaagtgactagggatcagaaaatctgggattgcacgttctactctacagctaattgactgtgacttcgagcaaattcctttccttctttgggcctatgttttttcatctgtaaaataaggaagatgatcaagggcaagtcttaatgatccctttcagctctttcaggtttttgcttctctaacgggggtcaggaaggggctgatttaagagactagtaggcattctctcaatgtgctttgtggttctttgtacatgctttatacttatatgggctgttcctcttgctttgaatgtcctcttgcttccctcctgcctctccaaatagtatcccactagctttagtccctccccacatccctgtctgtctcttaattccttcaatgctgttagctaggttagctatgtctaaccactttgattcctaattttatactatcttgtattctttgctgattgtttcctttgtaatcttgccttccaatacatactttaggtgctcctttccttctacattttagtttctcttaccctctacagcacctaaaacagtcttggttgtaaggggatactggagcaaattttgttaatcttgccccttttcttctggcagtgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaaggtatgcattttctattctcactacctgtcttccaaacatgtgacactttcccccaactgccttttagtgctgtgtcttcctccttggctcacgttgacagtgaaaggaaatcccattatgacacaatgacatttaatggcaactctgaccctgggaaattcattcattcagcaaacattgcttaagcttataactatattattttcagacaccatgctaaatactgggggtaatgaagaagaaaaagtcactgtctgtgcctttaaggtgttaacaatgtgtagtatggagacagatgggtaaataggaaaatgatagtataaaagtagtctatatacaatgaaactgtaggggagaagatatttatgttctcacccattgctagtttcatggctgagatccctataacaaaagaccgattaacaagagaaaagcatacaaatttatttaataagttttacatgacacaagaacctttagaaatgaagacccaaagaagcaggtaaactcttgcattttttatactaagtttgatgaaatggatcgttgtgaagattagtgattagaagacagaaggatatgatctaatggtaataaacttagggggatcttagcaaggcttgtttgttcagattcttcttggtgtttctgtgtcttcgaggatagggatgttcttttccttcagttatagggagggtacctctggaatgacctacttcagaggaaggtcagagaattcttttatggcctgctccaggggagaaggtagagaaaccttcttgcttctgctgtttccacaaacgccaaagtgccatattttgggatagcaggtcctgaactccatcaaaactaaaaagaaatcaatgcttacacttattcgaaccccatctcattccaaaagtatatatggtagcatattttatattgcacataaaatataaggcatcatacattataatcaggtcaagtacaaaaggtaaaacaaaggtagagtcagaaaatgatgcccagaatgaggttaagacaaatatttattgacaaattcttgtacacttgcaacagatggccctgcacactggggtataagcttcatagcagctagtgccatcctagggaaaagcataattcaataaagaagcacagggaggcaaaagcagcaggacttggtgactggaagtcaccaaggatgggggagagggagatttctgaatcctgattttctgacttggctgactgggtggatggggctgtccttatacatataagaaattcagaatgggaaagtttgagggagatagaggaaagttcagtttggaacaggtcgcatttgagatttgtgaaagacatccagggagcaatgcctggcgagcagttgactatgtgaatctaaagcagggatcagaaagcttttccttaaaggaccgtataataaatacttaagcctttgcaggccatggatttctgtcacaactacttagctttgccattgtagtgagaaaacagccatagacaatatggaaacagatggttgtagatgtgttctagtaaaattctatttacaaaatgggaaacaggcctgtgggctgtaatttgctgacccctgttctagagcccagatgtgataaattgataaatcaattgattcatccaacaaatatgtgtcgagtacccactttatgccaggtactgtttcaggaactctagatatcatcttcatagagtttatatttagaaaaagtaaacaaatagtattcaaagtaagtaaagtatataatattttagattgtaatgaacattaaggagaaaagcagagaagggaaataggaagggttggaaagtggttttgcaattttaaatacagataggaaaggagaaaataaggaaatgaggagggcctcacagagaagatgacctttcagcagagatcgatagggagtagaggaatgattcattcacctatccagagagaaaggattctaggctgaggaaatggtaagtgcaaaatcccagaggcagaagtgtgcctgtcatattcacggtacaacaaggaggccagactagctagagtggattaagcaaaagatgaaatagaaaaagatgggctcgaagagataatggagagggacagactagatcctgtagtggagtcttataatccactggaagaattttagatttgctctgcctgggtaagatagaaggggggttttgagcatgggagtgacaggatttgatttaggcttaacaggcttattctggctgcaatgtggagaatatgaaggaagtcaaagaaaatctagataaattgagatacatactgtgttcatggagtggaagactcaacatgataaagatgtcaattctttaaaaattataagtttaaggtaatcaatatcaaaatcccagcaagagcttttgtagataaagacaagataatactaacatatatgtagaaatggaaaggaactgtaagggctaatacaattttgaaaaataataaactggaggtaggtattaataatattaatgcttactgtattgcttcagtagtcaagacagtgtacaattggcagaggtaacccgataagtcctcttgtctacttcttacataaacaaatagaacagaatagagaatccacaaatagccctacagagtatggcctgattatttttcatgaaggtacaaaagcatttcaagggagagagggtagtcatttcaatgaattgtattggagcaattgcagctctataggtaatgaaagtgaacctcaacctaaacctctcattttatataaaaatgagctcacaaaggatcatacatttacatataaatcataaaactaaaacttgtagaagataatatagaaaactgttagagcctaggacttattgaggagacatgataccaaaagcataatccattaaagaaaaaaaatcaataaattgacttcatcaaaattaaaaatttttgctctgtgaatgaccctattaataagatggaaaaaaaagctaccgagatttggagaaaatatttgcaaaccacgtatctgacaaaggattaatatctagactatacaaagaactctcaaagctcaacagcacaaaaattcaatctaattagaaagtgggcaaaagacatgaacatgacgtatgcgtggcaattaagtatatgaaaagatgttcaagatcactagccattagggaaatacaaattaagaccatgatgagagatctctacacacctattagaataggtaacgttaaaaaaatatatagtggcaataccaactgctgacaagggtacacaaaaactggatctctcacacatttctggtaggaatataaaatggggcggctgctctggaaaacagttttggagttccttaaaaactaaacatgcacttctatcggatccatcatttacactcctgggcatttatcccaaagaaatgaaaacatgtccacacaaaacctttatagggatgttaattaatatttgaaaaaaagttatttaaagcattttacacatattagcacatttacacctcatttcacataagaagaaaccaaggtacagagaagttaagtgacttgtccagggtcatggagtaagtaaatgttggagctcaaatttgaaatcaggcagttcaaatgtatactttaccacctctagatctttgttatgtgttttgcaaatgggtacctgaagtaagtgaaggtgagggtcattatagatgagagagctaaggaactttgaggcaagagttgctgaagggtcatccacatagtaaagatttttgatagaaaataattttctaatcctagcatttggtggtcagatcatgggtcttgtatgcttggctaaggagtttggtctttatcctgaaggcagtagggagccttggaagcatattctgaacattcattatatgatgattcattgcatcttaaatgtcctaattcatttataagtggataaaggagtgacacagcatctcatcattagtataacaaaataatttttcttttgtttttattctatgcatttttaggggcaaatgccaacttaaattttattagaaaatgtgttggttggcaaatgacctcaatcccaatctagttcataaaagtgtgattttgctatgtccaaagcatattatgtggcatgatttgaaaagcaattaaatgctagttatctcttattcccaggatataataggaggccatttctattaactagtggtcagctgttaagtgagattttcacaccgttgtaacctgttaatatgtgttaagtagtcgaagttctgacctttgtgtgataccagagatgtacgctgaccatgttttccaaacaaagacatggtaaccaaggatcttttctgatttatgaatttatttcaaatgaaacatcttacatggagatatgaaatgaaatcccagtttattaaatacttatcaagttaccttttttgaaaaatagcagaatgatatatgggtgagaatgttccagaaattctagaccttatgtaggtgtaacctcacatggtggttgtgggattaaaagagataatatgtgtgagagctgttgctgcttcacacatagggattatatgttcctggcaagttgttcagttaatggggtatgatttttcagttgaaatatattataatttcagtaatgtgttttttccatttacacttgctctttaatagaaaagggcttaaacacattggttttaagttttctttgttactcctttctttcagtctctcttttaagagcatccagggtctgtaaatacagtgtaagtgaatcagaagagttgatgcttaaaggagtctattactaagtcttgcttaaaatttttttttaacaacttgaatgatcttttctaatttttttcttttttaagttggaaagtaggtaaataataggggaagatctacctctacactgattccctagaacaacattgccaattattctgaagttctctctcttcccatctcacttagcagtatgtatcagggtgcctgaacctcatgttgttggcttgaggcatagaggtaatttggactgacagaggaaggttgacttctgttttccgaacattttgttttggggagctgccaggaattagtggggaagagagaggtcatctctgaaggcggttcttagcaatttagttttgaggacagagctatttcacctaaggggacaaaatatagggtagatccatttgaattttagaactggaaaggggccctaaagaccttcaggtccaagcttttcattttatatgaagcctcttttcgcatgccatggtagtggtaacaggtttgcatttctgcagctccattcctgcttgtctactgtttggaacatcagctctcccccacagttcttcccaactagtttataaaagaactcggataccagccacaaacttttaccagttgtctaacttgtgctttgcaaactcattttctcacctacacaacctggcatcagctgttttcctcctttattgctcccaagaccactctcaaagagctagaaagcagtggttctgcccctgtagacttagatttgtattcagtgaacatggaatcagtgtgggacagcgtatttccagctcgtttagtcctttttctaactctgtgaatgatggatcgtatttccatttctgagataggaaatggaggcattgagtgtagtaagtggcaaagctgagacttaagtttaggtctatcaggttaaggctgcccctcagggaaagggggacctgttttattgagatgtgagctgtgcttttctttgcatcattgatgatgacttagctattctagctactcttgagttccctccttatttccagtctttcctttttagtgggtgggcatctgctttttaatcatacaggaaggatcttgcctaactgtgttaagtatagttttctgggagaatagttgattatttttgagataattagaaaatctattatcggtgtatgtcaaaatggattttagtcttactgcttaagatatatggttcagggaaatggaagactgaatggtatagtcttttctgcagacatggatggttgaaggcagttcttcctataaactggccggagaaagctgggttattctcagtgtggagtttgtgggaactccagtgttgcctatgttcccaaatggccaaatgggacctcatccaggaaaaaagcccatgtcgtagcaatgtaatggatttgagaaggcaaacaagagaccctgttaagaaatggctctgatttatatacttttcagacacccagtctagcaacctagaggaaacagacccttccagtcctggtctgtctctcctttctctaaaaggtggtgtttgtgaatttcagtctgccaccagagggtagcaagagaacagatgaatgtgtccctccaactgatttctggaataagatagatagatagatattttaaaatataagtaaatgtaaatatatagttatactttatagattttactgtatagatttatattttatacatttgtattttagaatgtatctctatatctacctacctacacacacacacacacacacacacacacacacagacacacacacttggtggggggtgggcgtcagtatgtgtaaagagagagaatctaattaagccaagactctacttcacatttaatttctgaaatgataaggttaagctaaaggttattgaaaataacatttttattatctgtacatgtaaggatattttcattagtctctacatgtgaatctaatatgtatttagcttggaatttggcaaacattctcaattgaatctggagaaaaaatatctttaagtttgaatattaagatcaaaacgtaacctggagaaaaaatatctttgagcagagaattattaagattgggagatttcagatgtatttattagttacaatgaatctttgaaaacgtagcttcaagttttccaccttggctaagtggaggtctttcacacattcttcaaatgcccagttacttatagctttgaagtgaagtcaggccctgtttgaggtgaataagcatgtccaaacccaatgagatagggtgataaatgtaggatgcagttgtgatctgaggtttgctccaatgttcagagagcagaaaagattccccttttgattctgggaattatgccgatgattcagaatgaggtgaaaatatccactccttccctttttctctctctagctggggctgtaataataattatcacagtaaaaatgatagcattttttgacagcttgctatgtgtcagacatggtgctatacatttgacacaaagcatctcctcgatttctcacaactttatgtagtatttacttacaggtaaactgcggtctacagaggttaagtttctatggactatcaaaatcaaatatctgtttttattttctttttggaggcttcgagtgtgtgtgggtggggaagaatatagaatcagagatttttgagaatcgaaaatatctccaaggtcatattgtccattcccctcaatggccagcgattttcttgtatcatatattttttcctttgctgttctcctttgagtggcctgaggtctcaggttggaacaccagagtctagataatacagtaagactggggccagtgtgccagagggccagataggtgtactttggcagctagacttaaagcagactgagcttcagcagtctggtgataggccaataggaatttcagaaaacaggaatcaattgaggagcaatgagagatcgggtggactttttctttgctctgagatttggagagtgaaaactgggtcattgctactttcttagattaagactccttaccaagaactctgaaaatgtccaggctacctctgtgagctcttcagatatccctagagtgagaataatggaaagaatggaaaaatagctttaaactagacagcccaggggttacatcccaactttatcctttactagctgggtggtcatctaaacaagccagtttacccccctgagccttgtttccctcattaaaaaaaaatgataccaataattagacatacttcatagagtttttgggaggagtcattgagataaatgtttcaagtactttgtacatagtacattggccactaaattttagtacttgcccctgccctataccaccacccctttgctgtattgacaggagatgagctctgtctttgtggtggcattccctcctaatacttttattaataccttggtatctactaagtctttgtagtcaaaagaggcttttcttagtagctgttacaccattgtttatggttgttaaatgatagagaaactctttaatttcccaacctaaacgcatcttaagttgatctaaaaagaaactgcacttggaatctgccatctcattcttagtagaaaactcacaatccatgctgagtagatagagatgtccttaacaggatctgactttatcttctctcccccttgatattttcttcccaagacaactgggaaggggaatgaacagacaattagaacacggattacagaccggttagatataatcagtggaagtctacagctgtttcaggcaggaggtactggtttttaggggaaatgacacccgattgggcattagaactcttggattctagtctcagttctaccacctactagctttggggccttgggcaagtcacttccccctctttggacatcgattttcccataagtatattggatgagtaggactagacaggattctggaatgttacatctaaaaaggccttaaagactatgtgttgctgagaccaaagacagccttagtgacagcccttttataaaaagctggctcttggtaacaacagacgtgatactttcaaagttctctacatactctaagcaaactcggtgacacacttgatgtttaatgtggtctgtgccaaatgctaagagctcattacttttgaccctttgccacctttgtttctagtgtagttaagagtatggtttttgctaatataaccagaacccagaaagctcaacatagccttagccagagtgtaaatggagactcagttggaaagctgggattcatcagggccaagtcttgtagctttgatttatagaaaggcaaaatgtttttttgtacaatctgatatttgcagccctgaagcgacatctggaaagaatctggatagttgctcatttctgccaagatttccaagagttagaatgggtctggatctcttggcctttggcaattggaaatgaccatcttatattaaatttcttctctctttcacacctaaagacatgacagagaagaatccgtaagggggttaatatgtgaccaaactcaggcaagcagttcattaaccctcttcccaatggaggtgatcgctctcctggcagtgtctcaaagcccagcaaattatccagatttagttcccagaagccttcaggagagggattccaggagttgggctccttcctgaatacaacccaaaacaacagccaaggcccatcagaatgaaataatattcctcggatattgagttctcttagaccaggcctttagaatggcactcagtgccaaccatatgcccagaaaacaaataagcactggtttgcccccagactctactttggccaccttctgggatttttttctgaagtcactatcagagaccatgaagccctaattgttcttaaccagtccacagaaagccaaatcagtctgtcctttttctggagttttggagggtgggaaaataagttctgcctgatactgtttctacccgaggagttatttttaaacttaaaatgtttccttctatggtttatagtggaaagagtgttagccttgaagtcagacacttctgagttcatatcatagccctgcttcttactatcaggtggccttggacaatgcacattctttattcccagccaagcctttggcctcacatcctctttctagtcttctccccagtgagttgatctagtctgtctatgagttaggaattcctacttaatttttcagctacagaagaaccactacagtgtccagaggagggaaaatgaaggcctataccctgtcaagttctagtgataattttctcaactttccattcattcagctttctaattattctttcctcccttaatcctgtggaaaggggtagatagagggatttattttgtggttaccctaatgcgctagttgttcaatcatgtccttcaagcccaggttgtctttgcagagaaaggaatttgtgttcagagaaaggaacttgtaaacactcaataaatgagttaatatacataaaacacttagacatgtgcctgacatgtagtaaacattgtagaagagttgaccattaaaactaactctgacccatggcttgaacttggaaaaagtttattccatcaaagccattttagtcagtcttctgggtcagcagctagtaccaccatttccaccttctattactgctgtcactaccttttcacaatgattgcatgagatgcataggaactggttttgcatcctgtgccacctagtatttgaccctttagaaagtctccatatgctatgagtttcccattcttttaggatttatttctgcttttttttttttggagacagagtctccacttctgccacccagtttggagtgcagtggcgtgatctaagctcactgcagtctccatctcccaggtttaagcgattctcctgcctcagcctcccaagtagccaggattatgggtgtgcaccaccactcccggctaatttttgtatttttggtagagacagggtttcaccatgttggccaagctcgtcttgaactcccgacctcatgtgatcctcctgcctcagcctcccaaagtgctggggttacaggcttgagccaccatgcctggttttatttctgctattgtaaaagggtaggttgttattccattctcagaacctgcttagaataagtcctttcatggatacacaagaagccactggggcattaggtagagcttgctaggtttcttttcttggacctattctaactcccttgtcagctctgaaagttttctcattaatattggactgccaacagtgagttaagagatcttgggcccatattctctttccttcctcctttcttaatagaaactgtggagttttccgcaagttgcccttcccaattccactagttatatctgtagtttataatcctgtttttaaggtaccaatgtcaccccttcattcaatgaatacttactaaatgcttactatggacaggtgaagttctaggctctggggatacaaacaaaacaaaggcccttttttgtgggtcttatgttctgctggagataaacaatacatcaggtggtggcaagtgctctgaagaaaaagtaaagcaaggtagtgggttgttcctttatggaagatggtcagacaaggctactgttaatgtgttatttaggcagagaactgaataaagtaagggtacaaagtatggtagatatctttgggaagagcaattccatgaatagggaaaacctagtagaaaggcccaaggcagcagtgtgcttggcatgttgaacagcaaagaaaccagagtgtctgggagcaaggatgacaatctgctccatttctcttcccaaaaggaatagcagtaacacacaggttaatgcccattgttaaaaaagagttttgaagtgaggcctttggagggccacagaccagaaaaagaggtaagtggattcttcttactacagcaattgccaatatttccacattaaagtttggcttgaatgtttgcatctgtaggccagctttgggaaggatgttgcaatccgtgatgactgcagggttattcaggccacattttaattttagagaagacacacaacaggaagtttcccctttgcttttctagacttttctcacttaaagagagtgtggttttaagcctaccaagcaccttctctgagctctgcctactgccacattggcaaaactgctctcaaccagctccttaccaatgagcctttcagtatattttcaggagacagggcatgtggacaacaccctgtccaggtggaattgtcagctctcattataaatcgtagaagtcagtgagcccatatctatcttaaggcctgggtagcttcttgaagaagaacaacctgtgaggaagggttttttttttcaatgagaagtgaataatttttataactggagcagggaaataagatcatttaatctgacagagagcttgaagagcaattaagttcatatcacctgatttgcatagcatgtaactgcttcactccctattgctccggtctgaaaatttctctgttcctccctccctttctctaccactctcctctccctctccctgtccccctctttcactctctctccctccgttccctccgttcctccctctccccccgttcctccctctcccctctctccctcccccctccccacctctttgtgtgtcttgtgttttctctttctctaaggaaacataggtttaagttctttttagggttcatgataattgcaataactaccacttactgagtgctcagtatgttccaggctaggttctttacatcaggtataccttgctttattgtgctttactttattgctctttgcaaatattttatttttaaaaacaatttgaatgttggtggcaatcctgtttcaagcaagtctatcagagccatttgtccaacagcatgggctcacttcttgtctctgtgttacattaggaaaattcttgcagtatttcaaacttttttttctttcttacatctgttgtggtgatatgcgttcagtgatctttgatgttactatgtaattgttttgcggctccatgaactacacccagacaagatagcaaacttaataagtaaatgttgtatgttctgactgctccgccgatcagccattcctcatccctctccctctcatgcttccctattccctgagacacaacaatattggaattaggccaattaaaaacccgacaaaggcctctaagtatgcaagtgaaagaaggagttgcatgtctctcatgttaactcaaaagctagaaatgattaagcttagttaggaaggcatgttgaaagctgagataggctgaaagctaggcctcttgtgccaaacagttagccaagttgtaaatacaaaggaaaaattcttgaagaaaattaaaagtgctactccagtgaacacacaaatgataagaaaccaaaatagccttattgctcatagggagaaacttttagtggtctggatagaaaatcaaaccagccacaacattcccttaagccaaagcctaatccacaggaaggttgtaactcttcaatctgtgaaggctgaggaagtaaggaagctgcaaaagaaaagtttgaaactagcagaggttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaagaaactagcagaggttggttcatgatgtttaaggaaataaaccagttccatgacataaaagtgcaaggtgaagcgacaagtgctgatgtaaaagctgtaccaagttatccagaaaatgcagctaagatcattgatgaaggtggcaacactaaaaaacacattttcagtgtacatgaaatagccttctgttggaagaagatgccatgtaggactttcatagctgcaaagaagtcaatgcctgggttcaaagtttcacaggacaggctgactcttttcattaaggactaatgcagctggtgaagccaaggctcattgaccattctgtaaatcctagggcccttaagaattatgcaaaatctactctgcccatgctccatatgtggaacaacaaagcctaagtgacaacacatctgtctacagaatgttttactgaatattttaagcccactcttgagacctactgctcaaaagaaaagctctctttcaaaatatcactgcccattaacaatgtagtaatcacccagcagctctgatggagatgtgcaaggagattaatgaatgttgtttccatgcctactaatacaacatccattctgcagcccatggatcaaggaataaagtaactttccagtcttattatttaagaagtagatttcatcaggatttagatcccatagatagtgattcctctgatgaatctgggcaaagtaaatttaaaaccttctggaaagcattcaccaatctagatgtcattaagaatattaataatttatgagaggaggtcaaaatatcaacaaaataacagaggtttgaaaaagttaattacaaccttcatggctgactttgaggagcttaacccttcagtggaggaagtaactgtagatgtggtagaaatagcaagagaactagaattagaagtggagcctgaagacgtgactgaattgctgccatatgaggataaaagttcaatggatgagaagttactttttatggatgagcaaagaaaatggtttcttgaggtggaatctactcctggtgaagatgctgtgaacattgtggaaatgataaccaaggatttagaatattgcataaacttggtttactaaagcagtggccgggtttgagaggagtgactccaattttgaaagaagttctgagggtaaaatgctatcaaacagcatggcatgctacagagaaatttttttttgtgaaaggaagagtcaattgatgcagctaacttcattgttgtcttcttttaagaaattgccatagccactccagccttcagtaagcaccatcctgatcaatcagcagtcatcaacatagaagcaagaccctccaccagcaaaaaagggtatgatttgccaaaggctctggtgattgtcagcattttttagcaataaattatttttaatgaagggatgtataccttatttttaggaatcatgctattgcacacttactagactacagtatagtataagcaccatgaaaccagaaaaaattgtgtggctcagtttattgtgatacatattttattctggtggtctggaaccaaatccacactatctcctaggtatgtctgtatgttacctcattcaaccatcacaacaaccctatgaggtagatggtatcactattctcattttgcagctgacattttcaaaatgcaaactgagcttcaagtttgagattcatatagtttaagtttcttgcccctggttacatagcaaagctccaacacaactgactctgactctgtcctgactctttgacctctactttgtactctctcacctctattttgtactctctcttcccaattatagttggtgaaggaataaatgaaaaaaaaagttctattatttaatatgctctaaagggcctggtagccaaaattcatccattcattttaaaaactgtcattgagctgctttatcttgcctcgtgccctactcagccctagtctctagagaggaatcacgaaaaaaaatctctgctgtcagaaaagttatgggacttgggggtatctggaaccaactaacactcaggatgcagtgtaataaagactgtggtgaagatgtgcattggatgctgtgggagcccatggaaagggaacttacctctctattgggaatcagagaagtcttcatacagtgggtaatgcatgatgtgagtcctgaaaatcagaggagtagattaattgattaaccttctgtaagaaaagtcctcctataacagaggactgcaaattatttggcttaaatatgatggagaggagttcatttttctctcacataaaagtctagcagtgaatagtccaagatcaatgacatacttctgccatcctcaccacttggcttcagtttcttgatcctagatagctattccatttgtccccatttactagccagagagaaagggaaaaaaagacagaatgtaatacagacagcttcttcataaaagcatgacccagaggctttcatgcattatttctacttgtattctgttatctaaaacttaatcacatgtccttacctagctgcaagggagactaagaaaggtaggcatgggtgcccagctaccattcagtgacttccattagtaaaagtaagaaggggaaggtgggtaccagtaagcaattagcagtctcttccataaagggtaagagtgaaagtgttctgtgtatagatcactctggatacatacaggaatgagacaccagagaaattaagttccataaaataaccaaagaactaaataactaagagactaaagaactttaataattcagcatggctatagtggagggtgaatgtaggggaatagtggaagatggggaagatggggctggagatttcaggatgtggccagattattgagtactttgtgtgctaactaaggaatttggcctttgtcccgaagacagtgaagagtcattgaaacattttaagcagtggagtaacacaattagattagagttgagaaagatcactctacctgcacttgggtagacagattaaagacaggagtggctggagacagaaggaacaattaggagactattataatcatagagagacatgatgagactcaaccaagtcagtggtagtgagcagaggggacagattagagagacattaaggaagtataattgatagaacttggtgactaaatggatgtgggatgtgagagagggggaggattttaagataataatgtccagatttgtggcttggacattggcattgttttagataataaaaaattttaagggacgaaagtgtttaattctagaaatgttgaatttgagatacctctgggatatccagaaggcaacattgagcagttagttagatatattggtatagaaaccagtagagaaacttggtagtgcaagccatgtgagtggatgacacggttgagaaagcgaatgagtgcagacaagtgagatcattagaaggttgaggacataatcctggagaacattaaatttcagagagagccagtgaaagagacgacagtgttcagagaagcagaaaggtaaagagagaggaatttttagaaatggattggttaaatgtgttaaatgttggagcacagtcaaaataaaaattgaaaaagtacctgttggagtcagcaatcagcaggccagtggtgatcattgtaaaaacagttacagaggagtgatgtgggcagagacaaggttgaggatcaactggaggatgaagaaatggagacttaactgtctggaaagtgtagaagaaaatgaatgtgatggcagtggagagtagcttgggttcagacaggagagacttaagttcatttaaatgcttttgagaaacagtattgtaagaaaggagatgaatgatggaggaaggtccctgagaaacaggaagagatgagatgggatccagagcataggtagaggcattctccttagaaagtgaggagagataaagtaggtttataagtgtggatgtcaatgagtttgtcagtatggggacagaaagttgaagttgtttactttatttatttatttatttatttatttatttatttatttattttgagacagtcttgctctgttgtccaggatggagtgcagtggtgcaatctgggctcactgcaacctccaccttccagatttgagcaattctcctgcctcagcctcctgagtagctgagattacaggcatgctgcaacatgcctgactaatttttgtactattaatagagctagggtttcaccatgttggccaggcttgtcttgaactcctggcctcaagggatccgcctgcctcagcctcccaaagtgctgagattacagacatgagccaccgcgcccagctgaagaagtttacttctaatgacctcccttttctctgaagtatgaggtgacgccatctgtgagggagggtgtctatggtctggtatattatgaatggctcagcaaggatgtcttctaactgagcaaagggaaataatatatgatgcgtttatctccattaataacactcacttgggttcaatcggaagagattgttggatggacagatgcatggatggatgcctataaacataataaatatgtattctgttttcctccactcaatgttttcaaaacgtttttttagaagtttagttcagggttaaaattttcttgaatcccatctgcattaagtaagtatattctcatttgttattcctcttcattattctagaccaacatttttcagccttggtattattttgacattttgggccaataattcttgttgtggggactgccctgggcattgttggatgtttagcaggattccttgcctttccccactagatgccaaccccccttccacagttgtgacaataaatattttcacagatgtcatgaaatgtcccctggaaaatagaattggccccatttaagaggttgtattcaaaaccaaatggaagggccctggagagagagagagagaagggggatttaagctagacaaatactcatgtacatttatcagttgatcatgacaactatactcatagacatgatcttcttttggcaaattagacaactgaggctcagagaggttaaatgacttgcctaacatgacagaggccataagtgatagagctggggtttgaactcatgtgtgttagatccctacaatttaggttctttcttaagcaacaataaaaaatattttagagggtgtccttgttttcatttttattatgttttaaaaaatcaaactaaacttaaaattcagcacaaaaatttaaataatatagaagtgtatagactaaaacaggaatgtatctgttgacattcctctgtaatcctattcactttcctagaggttatgattgtgattgttaacaatttaatgtgtatgcttttagacccttttctttgcaattataaatgacaaaggacagtgcattcatacacacacaaaactatttttgaataatgacatcatactatatatactattccataagctactttaaaatatttaatctttccacctcagttcttacaaatctacatcaccaccttttaacagttgtgtaatattcctcagtgagtgaaccacaatttatgtaactttcccatgttaatagatatttatgtagttttattttttttatggtacatggaacttgcatagatatcagtgtgtgtatgtgtcaggatttctgcttaataggggttttaaaagtagggagatcagaggtcttgcctatttaaaatcatgattgctactaccagattgacccccaatatggataaaccaaatcatcctcccaataacagcttataaaggtgactgtttttacccacttctttgtcagtttaggacaatatcgatttttcttaatttatcagtctaataggcaaaatgtgatatcttgtttgaattgtagttttataattattagtgaagttgatttttatgttcacaagctatttcattttcttttcctttgtatgtccttttcagtggctggtcgcttcaaaatcctcccctctccaggccactcccacactaaactcttcacctaaggcaaccactaatcagttctgttagtataatttgtgtttcctaaagttttgtataaacggaataatgcagtatatacttttcttttggtctggcttctttggttcagcatagttattctgagattaatttaagttgttatagtgagtcaatagttcattcctttttagtactgagtagtattccatcatatataccaaaatttggttgtctattcactagttaatggacatttgggttgtttcagtttgggtctgctgcaaacatttgtgtacagtctgtacgactatatgttttcttttttcttgagtaaacatgaaggagtagaaatgactgagtcacatagtaattatacatttaatttttaaagaaaacgtaaaacatttttcttaagtaactgtatcattgtactttctggaagagactgtaaaactcatgttaattctgtatatgtttggtggaatcctccagctaaactctctgggtctagagatttcttctttggaagtttttaaactatgaattgaaattttttaatggttataggactattcagatgatctatttcattgggtggtttttttttttaattcactatgacattgtatgattttacattcccatcagcagtgaaagttccagttcctccatattcttttcaacatgtggtatggtcagtctaaaaaatttcaaccattctaataggtgttcagtggcatcgcatcatgtttttagcatgcatttccctattgacttaatgatgttgaactttttttatgtttgccatttgtatgttttctttggtaaagtgtctattcaaatattttgcttattctttaaaaactgatttacttgttttcttattattgagttattgagttttgggagttctttatataatatatatataatacaagttctttatcagacatatgatttacaaatattttaactcagtctgtggtttttcttttcattcttaacagtgtcttttagaaaatcatgagttttcaaatttgatgttcagtttattgattattttatgaatcattgtatctaagatatctttggctaacctaagattacaaagatttttctcctcgaaattttatagtttcagcttttaaatttgattatagcccattctgagttagttttcttctgtggtataagatacgaattgaagttttttttttttttttttttttgcctatgtatatcacattgttccagtaccattgctgtcctttctccactgaattgcctttgtaaaataaataaataaatttatctgtatagatgtgggtctatttctgggctttctattttgttccattgatctattcacctatcttgacatcagtgccacactgtcttaattgttgtagctttataataagacttgaaatcaggtagtgttagctttccaactttgtttttctttttcaagattgttttggctattctaggttctttgcatgtccttatacatttttgaatcagcttgtcaatgtctacatacaagcttactggtatttgggttgtgttcagtctgtagatcaattttgtgagaatttacatcttaacactattgagtctttatacctgcaaacaaaatatatctcagtttatctagattttcttaatatttctcagcaatattttgaagattttagtgtacaaaatctctctggcactttgccttgcaaattctcacttccttgtctttcccatactcccaattcagtcttctcaacgtagggatactactgggttccacttgggttccccttcctgcactgcagcctgcaaaactctaagctgggaaactcatagggctgacctcatttgtttttttcagtctctcagcattcactgtccttcactgctggatttccaatgcctttaaaactactgttgcatgtatttttcctagttttgttttgtttttacttgtttcaggctaaatgagtaaaactagtttctgtgccctatcttggccggaataagatagtagctgtttgtagtagtattttagtagtagtagttagtagctgttaatagtagtagtattttcaggtgacagtttggccttttacattagaattgcaaatgtatttgttttttgcctcagcaattccagtccctcttctaggtggtggagatagagcagtgaacatgacagacatgcttctatgttgtgtaaaatctagcttggagacagacagcaaacaaaatcaataagtaaaacgtgttatatgttagaaagtgataggaaatgctgaagagaaaaaaaattaaaatggaaggaagataggaatgcttgcgtagagggaggcatgtcattgttttaaatatattgacctggaagggcttactgagcagagtatgtttgattagaatcctagaagaatggatatctgaaggaagatcagtctgggtggaagaaacagtcagtgcaacgacctcatgtattcgaaaaatagcaaggaatatttgtaacaactactacagtgtttgagctcacaaaatggtggctctttagactattattactaatgatggtggaattaggaatatgacctagaaccgtatggcctcaacattaatctgcttgctgttaagttacattttgtcttccttacaatcatgaggcatatactcacggtttgtgattgttcatgcattgtttcttatcattgtccaccttttacacagcttgccttgtgttctcaatcatgttatttccatgcccatgtagtctgtgttgacccttgcctgatgggatattgggctctgacatttctctttacactaatcactggggttgattttgttagtctcactggctagacagtggtctcctttctccatcacatatgtgtatcatcccatagtgtatgcacttgggctaaaaggttggtctccatggagactggaaaatccttaagtacacatgagacattatataaaaattctaatcacagctccttctgcatgccttcggcacttcttatagcatccaaggcactgtgttgttgctttttaattttattttactttttattgaatagataatgtaccatggcatgaaattataaaagaacaaagtgacataggagggaaaacacagttgttctccctgtattccccagccaatcattagtcctaccttgagacaaacaatgtaatcagattctttggtatcccttcagaactatttaaggcatatgggcatgtaattgtgtttagtctccttccatgtcctacccccacccatagaaggcaccttgacagctcctttaatttctttcttaccacactctgtgaagtgggtgatgctgtccctatgttacggatgagaaagccaaggctcagagaagtgaggtgacttgcctaaggtctcccaggaaggacatggaaaatccaggactaatgccatcttttataggcattttttcttccaaactgagaagtgccaggttctgtgccttgagcatagtaggagatacctaaacatttacctgtagctagagtgattaagaaaatctctgattctttgagtcatgttagtattcacgttacaaactctagatataaggccaacaagcatcaactggtgggtagcattcagaagacaaaaacttgatctaattattctctagatatcttccttctttctccacagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaaggtcagtactgaggttcacctttagcttctgaatggtgattagacacaaagaggatatcgaagggcagaagcggtggcatgaccatttttctctctataaaagtagacctttcctggctcctgagcttaaaagcagccagggtttgtagtttgtgctcagagaggggattaagcctttgacagcagataggatggtgatgagcttgtaaaggaagttaccacgtggaggatccctataaggccagtgcaggatccaaggtgttcttagatttatgcccccaatatattgaaatgggtgagcaaggtgaatgttgtgaaattttaaattcaaatatagcaaacacggattggataactactatgtgccaggtactgtgctaggtgaaattaagatacattgcttgccctcacagaagaaatggagacatagataagtgaagaaataaatgccttcagtggaataattgctagtgtggagactacacccattctaaatgtgcctctgccctcctactccactaagaccatttttgtcaggtttgccaataatctccatgaggccaaaccaaatagctacaacattgttctcatcatactcagtttgtgagtagcatctgacacagttgactaactcctccttcttgaaacactttattcacctggctctcaggataccagattttcctttaatctcaccagataatccatctcagtcttctctcctggttttccttctcttcccaactttacatgttagaaggtcccagagcttttttcttagtcctgttctctgatcatgttcttttcctgtgtgatctcattaaatttcatggttttacatatcatttaaatgctaaagatgatttccaaatttatctaagattgatatcttgcctcttttgtcatatcaaatttcctgctcaacagttctccttggatgactcatgggcatctcagtttacactgtgcaaaacataacttgatgcctgactctttcttaacctgctcctactctggtctcctccatctaagtaattggcagcagcagtcatccagttgctaaggtcaagaactttggaatcatccttggttactactttccctttttccttcatattgaatccattggcaattcttgtcagctctacctgcacattatatgctaacttctactactgcccactgcttctatcactgtaagccactattatctcttacctggtatcattgcttgccttcttccttgcctgtaattcattctccccggcagccagtaacagcacatcctttaaaatatggaaatcaggattctgcaagcttcccaagcacacatcagcagccggctcccttactgtctgaatcatcgacctctctccatttccaaaatgtcgctttctaacaagctgacattggacaaaccagacgtcaaagggcagcgggtcattatgagagtggacttcaatgttcctgtgtagaataaccagataacaaacaaccagaggattaaggctactgtcttaagcatcaaattctgcttggacaatggagccaagtcagtagtccttatgagccacctaggccagcctgatggtgtccctatgcctgacaatactccttagagccatttgctgtagaattcaaatctctgctgggcaaggatgttctgttcttgaaagactgtgtaggcccagaagtggagaaagcctgtgccaacccagctgctgggtctgtcatcctgctggagaacctccactttcatgtggaagaagaagggaagggaaaactctgggaacaaggttaaagtgagcccgccaaaatagaagctttccgagcttcactttccaagctagggaatgtgcatgtcaatggtgcttttggcactgctcacagagcccacagctccatggtaggagtcagtctgccacagaaggctggtggttttttgatgaagaaggagctgaactactttgtgaaggtcttggagagcccatagcgacccttcctggccattctgggtggagctaaatttgcagacaagatccacctgatcaataatatgctggacaaagtcaatgagatgattattggtggtggaacggcttttaccttccttaaggtgctcaacaacatggagactggcacttctctgtttgatgaagagggagccaagattgtcaaagacctaatgtcccaagctgagaagaatggtgtgaagattaccttgcctattgactttgtcactgctgagaaatttgatgagaatgccaagactggccaagccactgtggcttctggcatacctgctggctgaatgggcttggactgtggtcctgaaagcagcaagaagtatgctgagactgtcacttgggctaagcagattgtgtggaatggtcctgtggggggtatttgaatgggaagcttttgcccagggaaccaaagccctcatggatgaggtggtgaaagccacttctaggggctgcattaccatcataggtggtggaaacactgccacttgctgtgccaaatggaacacagaggataaaatcagacatgtgagcactacgggtggtgccagtttagagctcctggacagtaaagtccttcctggggtggatgctctcggcaatatttagtacttttctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatctttactgcaccctggatttgcctacattcttcaagatcccatttgaatttcttagtgactaaaccattgtgcattctagaatgcatatatgcatattttgcctgttaaaaaaaaagtgagctgtgttagcttagttctcttttgatgtagcttatcctgattagctttgtcactgtttcactactcagcgtggaaacaagatgaaattccatttgtaggtagggagacgaaattgatgatccattaaatagacaataaaagtgtccattgaaaccatgaaaaaaatggaaatcagatcacatcattccctctgtgccaaattttcagtaacctcccttcatacctagaataaaatttgcattttattcttcattatatgactgttgcttatttctgtgaccttcatttctgaactttgctctctcactgtctcttttgctctctactgtaatctcattgttcttgcaggtccttacttgtgtcaaacttacctaagggcctttgcatttgctactctcttggccctaaacattcttcctccagaacttcacaaggctcactctttcattcaggtgtctactaaatgctttcttctcatagagaccttttcttaacattctacttaaatagttctttctcctcctccaatcactccctatccctttatatggcttaatgcaactcatatcccctgcttctgtttgttcacatgtttattatctctctctcccattagaatgtaaaatctatttgattaccaggccctagaacaactcctggtatacatatcatgtatttagtaaatattctaagaatgaatgagtggatgtataaggaatgatgaagagattatcacttaggttaagggatcaactctttgacagaggaggtgagctggcattcaggagaaagtggaggggaacattggatgcctgtctgttgttccatagtctcatttttacagaatgggtttgtttatttacagtctccccaaatataaactctatgccagtggccacttgttttttttactatatccaaagcatgggcacagtgccaggcatatagtaattccttaataaatgagtgcaaaaaatgaatgaactgtgtgtcagtagatagaaggtctaatttaatcttggctactagcctgctgaataacttgagctagtcacttcccctctctggacctcaatttgcccctctgtggtgatgagggctttgggacagaagatctccaatgaggttacccagtctagacattttttatttttaacttttttaaaaactgagctataattcacataccataaaatgcaccattttaaagcgtacagtttaatggtttttagtaaattttgtgcaactatcttattccagaacatattcatcatcccagaatcccaatacttttaaatttacttctcccccaacctctgacagttactgatctactttctgcctctacggatttgcctattctgaacatttcatagaaatataattatagaatatgtggacatttttgggtggcgtcttactcttagcataatattttcaaggttcatccacattgtagaatgtatcagtacttcattctttcttatggacaaataatattcctttgtatagatgtagcacattttatttatccattgatcagttgatggacacttggattgtattcattttttggttattataaataatgccgctgtgaacattcatgcacaggattttgtgtggatgtctgtttttaattatcttgggtatatacctaggactggaattgtaggttatatggtcggtctatattaaaacttttgaagaattgccaggctgttttccaaagcagctgtacctttttttttttttttttttttttgagatggagtctcacagtgtcgcctgggctggagtgcaatggcgcgatctcagctcactgcaacctccgcctgccaggttcatgtgattctcctgcctcagcctcccgagtagctgggattacaggtgcataccaccacaccaggctaattttttgtatttttagtagagatggggtttcactgtgttggccagactggtctcaaactcctgacctcatgattcgcccacctcggcctcccaaagtgctgggattacaggcatgagccactgcaccaggcctcagctgcaccattttactttcccaccagcaatgaatgaaggctccaatttcaccacatcctcaccaatactttgtatagtctgtcttatttattctagccatcctatgtgagtgtgaatccataatctcatttaatgttcagcactcccatgcgaggtaggtatgctgaattctgttttatagtgaaggcactggaagctcaaagatgatgagtagttttcccaactaacacagctactaaatgacagaacaatttgcactcatctatcttatcctaaagcttatttatttactataatatcacacttcctataacctgtctgaacactgttctgagaaggaaccaatcctgctcaccagtagcatctcattatctcactctgaaatttgatatcccttttgtatatagtatgtcagtgactcctttcaccctcgtcatggactccatcacacctccataactaagccctgattattccacttctttaacctctcttgaatctgcctctcttttctgacgcagctctagtttggatccttctcaacagcggtcccctagcttgtctttctgccaccagtctttctggtccaagctacttttcattggaacgagcctatttttcattacttttcgtaatgaacccaaagggatgtttaaaaatgcatatttgataatgccacttctccccacccacagccctctgccccccaaaatcattgtcttctgtgactcaaaggcagagtttgtattcctgagcatggcattcatggacttcatgatatagccccaacttattgcaacaacctcacctccagctacccacactttttcatctgtaattggtccctatgctcaagccaaaccaaacttttaattatattttcttaggcaaagcatggtctttcactcctccaagttgttttttgtttgaatgccctttctactttgctccaccttttggaattcttcaaggcccagcttaaaagttacctgttttataaagaccctctctaatccttgcagtcagtattagtactgtcttactcctagcacttatttgcatgaatctacatgtattataataattgatttatttctattactgtaccagtgtgtatcctctcaaagcttctccccacctcttacccacccatggaagagaggcctccactttaagggttggccccacgcctatttatgaggcctccctgtctcatcctgattcactcccagttcttcgtagtccctgagacttgtctgtgtgttttcctgtagaaatgggtggctggttagggaaaggggatggcaccgaacttttattacctgacagagcaatgaactctcttcagaaagagtaagtagactctggaagcagacttcaagatttgaaatttggcgtttccacttagtagttttgtgacatggagactgcgggtgtcttagattccttatctgtaaaatggggctagtaacaatgtactactttatagagctgttttgaggattacatgagataatccaggtaaagcacttagaacagggtctgccatggtataagtgctcaagtaatggtatgtgttgtctttatcagtattattctcattattactgtcattgtcactattatcattatttttattcaccataccccagaacctagaaatagtttccctgctgaaaggcctggctccgaagtcatcatggcttctatcattacatttcctattttcccgagccagcagaagatactttcctgagtggaaggtagcagcctctctgaggctgtgtatgtgggtcctctttatgaagattggctctcttgagatggtgatgttactctatggcctgtagggcacaggcaacctttatttccctaagggagagcagagatggagtcacttgtccagaagaaagtattcagataggaacatgcagctgagatgttgggctaaagcatgtgagggaaagaatttatgtcaccatgcactttattgtttggagagagtagatgtgcttgagttactcctgagtgctgtgtttaaagatggcctctgccacaaggcacgtcctggaagccagaggctctagttatttggcgctcttgtgctcatgttcatgccattatttgtgagcctttggtagttttttgtttgatggcctctgtctggttgcacttatgctagggttaataaataaagggctatgtgtctactttgggacaaaattagggagactataggggaactccccttggttccggcccctttggcagtggcatcagtggtggcaaattcccaaggagaataaaactgtctaggggacaaaaacctttgcagcaagacttcccccatggaaacttttgcctcactgcccacccaccacataatagtgtaaataataaccaccaattaatgagtgtctgttatgtgccaggcactgaaataagtatacctaccatctcctgtaatcctcaccataacctcatgagaccggtattctttattattcccgttttactgaggagaaaatttgaggtacagagagaatagggaacttgtacgaggtctcacagtcggtaagaagcagaactgagattcagacctggccacctggcttcagagcctgcatttcttttaacattttattgcgaagaattccaaacataaacagaaattggaaacaaacgtattgaactccccacatttcagcatttaaaaacatatatcaagtcttatttcatctatacccctacccgttcccccaacctactcatcatgtcatttcatttgtaaatgtttcagtgtatatctctaaaagaaaggaactcttttaaaagcaaaaccgcaatatcatcatcatacttaaaataaaacaaaacagtgattccttaagatcagctatccagtcagtatccacattctcctattatctcattttgttaaaaaaaatatcaagatctaaataagatccatgtattgcaattggttgatatatatctcaggtttcaatttgctggccggaacctctgttctttttttttattattattatactttaagttctagggtacatgtgcacaacgtgcaggtttgttacatatgtatacatgtgccatgttggtgtgctgcacccattaactcatcatttacattaggtatatctcctaatgctttccctcccccctccgcccacctcacaacaggccctggtgtgtgatgttccccttcgtgtgtccaagtgttctcattggaacctctgttcttaaccactgcactcgaagttttttatgactatggaaggtgacaatttctttacagcaggcattctcaatctggggtttattgacagcttcagaaggctctgtgaatcactaaaaaattagttttcaaaatttttgctatatttgtgtgggttaatttttctagagagatggtccctaggtctcattagggtctcaaaagctttaagtaagtctcagaaccactgaaagacatgtactaatgtcagaggaaattgtagaccacaaaagctggggaaagaacagttggaggtttccttccgggttggagaacgaagttaaagtatgttatgttgattaacttaaaatttgagagaccttaacaaaatacttttcagagaagtggttaagaattaactgatgatgtcttcatttgcaaagaatagaatatgccattgactggggactttaagtcttttttgagtgacatattcctttaataaaacctcttggtttactgtggcttattgaattgtggtggtgaaaatcatacgcggatcttgaattccctatttggattggatctgtggctttacatgaactgggaagggtagagaatgattttgtgggatatagttggtttgtgccacagtgacataactgctttgaaaatgtatacaaattttcaaaattaagtatgtatgcatgtatcaaaatgaaaaggttttaaaagttatcattaatcttccctcttggcaccaacttttcctagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggtaagtgcttgggaatcccatgggagccagagctgaccctaactacttttcaccttgagatccttctgagtttggagatatatttaagtggaaatatgttccagtttactaccactaatattggaacagtgggcaagatcacaataatcagtcacaataatcactagaatgtaagctccatgagggccgggattttttacctgttttgttgacctctatatcccaagtgctatgtgcctggcactgtactaattgctgatatactatttcttatcctcacaatcccactgtaaagaatgtattattcttaatattttctttttttttttttttgagacggagtctcactctgtcacccaggctggagtgcagtgacgtgatctcggctcactgcagcctccgcctcctaggttcaagtgatttccctgcctcagcctcctgagtagctgggactacagacacttgccaccatgcccggctaatttttgtatttttagtagagacagggttttgccatgttagccaggctggtctcaaactctcgacctcaggtgatccacctgccttggcctcccaaagtgctgggattacaggcgtgagccaccacacctggccaagaatgtattattcctgtttttttttttgtttgtttgttttttttaatttggaaatggaggctgctgtagataagtgacttgccaaagattcacagctaataactggcagagctgggatctaaatcttaccatgtctcacaggcaccaaagcctgcgttctttccactgaggcagaactatcactttaccttcctataagaagctatgaatctgtgaacccttgttttctcattctccctttccagtttgggagaaatagggacaaaggggcacaacttctgccaaactctggatttttgaaattattgcaaattcaaggtgtggctgacttcagcaaatttaattaactattgcatgttgagacttatgttgagagactggggctaatccagaggggagttttaggggacacaattctatgaagatagtaagatataatggacaaaataaggatttgagtatcagaaaggcttggatctaaatcctagctcttttactttgtagctttaaggaatttcacaatatagcaaaatgtaaaaccttaaaaaatggttaagaataatttatttgacaaatatttattgagtactgaccatgtacctggccccattctacatgccgaagacatagaaatgaataagacttatgaagtccctgtcctcttgaggtttagataagagggcttggcagactatggcctgtggacccgattgggcccactgcactgcctctttttatatagcctgtaagctaagaattcttttttacattttttaatgtttggaattaaaaaggaaataatattttttgacatgaaaatgttgtgaaattcaaactttgtccataaacataaatacaccccttcatttacatgttgtctatggctgctttcatgccacaacagcagaattgagtagtagcaacaaagacttcatggcctgcacagcctaaaatattaactgtctgacactttacagaaaaagtttgctggcctttaccttagattctagagtactgataagaaaacatgaggcccagaatgggaatcgggaggttgggagaaggtaggatagcaaggaaatggcaggaatggagttagtatacaaaatatttgccatgaatacttaaacacttggtggagcagtgtcacaggtttggttccaaactttctagagaaaacaaaaagagagaaaccaatggttatataactaagttcctaaggtaaaagcaagccaattgttcaggtaagccataacttttctggttttgaggccagggaaaaatttcttccatggattatttcatataacaacctcagtatgaaccaatggcattgtctcagagcacaatttagtaaaagctattcagtgtgcggatgggagggggtccagtacaatttctacaagtccagtacaatttccacaagtagttgactctgaatgctctggtttgatccactgatgctgatgtgatcactcatgcgatcacagttaatttatgtaagctgtttgtaccttggtttccagatctgtaaaatgggaaaacagttcacctgttagaattattattgctaggattaaaaggaatgacaaaatatctggcgtataatcagcattcaaaatatgatattgatttccctcccctgtccctcttctcactatgacttggctcttctgagacatagccaagaaaaggaaaactttaatgtagacctctgcttctgtttttaagtcatgtcgtgaccttcctatcaatctgggtagaaggttgggtaactcaacttatactcgtcacagtaaaatttgtcttgtctgttgccaagccttgagactggccagattctatcagctcagcgcacacagtaactcagccctccttccctccctcctgcaaagttcaatcccagtggcattcccctcttccccttcctccagtcctaccctgggctgctggcggcagctactctgatctaatggtctcagctaatgtaagtactgatctgacttgttcagtatcagcctaactatctaaatctgggcctcagctttgcctggcttcattttctgctttcaatcagttagcaacaggctggcacgatgcagctttttttcaaaaccccatgcttccagctttggctacagaaagcagaactgaggtggttttggccttggtggagaaccccccaaacctctggtatagttgcctctttgaacctaacctacactatctattcacttcttacttcctccttgctcccctcctgattctggctgcttctcctagtagattccctggcatctgaagagttatcggttaagcaaaagccacacacagctctgaccctgtgctataactggtagttgtttgctcctggtactggccagtagcctgaatggcagtattagagggagggaactgttacctcagccagcccagtctgtaccttgcagttgtcaccccatttcagctctgttgtttaggactttgcctgccatcctgaggatcagtacacaggctccattgcattagtgagccagctgtgccacagtcctgcccccatcttcaccccttgcattgacttaacatttgagtggccttaacattcttcacattttttctcagcaattaaaaataacaaaagcatggtgcatgttaaattgcttttttccatgacagtcaactttaaaataagaatcagtagtgtttgctgatggaattttatcaaggatccttttctgttccagacatgagcttgatactttcactcttctgttgcgtctaatcattgtgataggccttgtgaggtatgatttaccctcccctttttatagatggagaaacagaggctcacagacacaaaacaacttgctcagagttacctaggttgtaaggtgcagagatggggcttgacctcagcttcttgggttcaagattgggactctttttctttataccatatttcttcagcagcgttggccatcttctcctttctgtttttctaaggaccacttacttttgggggggtacaaaattatacaagcctatttttttctgccttcatttgagtttactgcctcttaggtgtcctggctttgcaaagggcaggcatgtagctaccgcaaagggatttaggactttcctttgggtaatgaagagggaggagggctatatcccatctactttacatgtatttgtttatttaatcaggtataatcatatgcaaagggagagacaaaaatgaaaagccattgtctctgccttccaaaggtttgtggtgacactggcatgcaagcagtcagtcccagccaatgtgattaatgttctagtaggggtgagaagaaattctagtaggagcatggagcaaggagaccttcattctacctgaggtattgagatgaaagtgaagagcacaccatggactgggactttatgacatatgggttgaggggcccttcttagctcctttcctctgtcttggctggaaaggaaagattgcatctggtggcatgcttttgggcttgtaaggccttgctcagtcacagagccattaattctccactgaggtgactaatgttatgagtggcatttgcatctactctaaaagtattaggaacagacttgctcttgcagtaatgggtgttgctggccattatccacattttcttgtttggacttatgctttaataatctactgtttggtttttattctctacttttcttggagcctaacgccaaattgttttataaggataaataatggctaaggaagcaggaaggctttaaggtgagcatggaggagtgtcatagaaaaaaagaggtaattctaggtgactgggggaatctacaagaggaatcaacctcctcctactctgtgccttcaggttgggtatagaggaatataaggaaaggtggaaaaaagttgctaaggttgaatactgatgaccatcaggtcccaagaactctgcaaatgttaagattctttggttatggtcatttgacagagattagagagagagggaacaggtggggcttgagaaggagatcaagtttgtagtaaaagccaggtttcggaccaaagttgaaaagaaattaaaaagaagtacagcttggtggaaagcctataggctcaagtgacttagtggttaaaagctcaggctcctgaatcttccagatgtgagtttgaatcctggctctgcctcttcctagctgtgggactttgggcaggttacaacctctctgaaccttagttttctcatttgtataatgaggatagtatttgcgcccataggattgctataacaacaaagtgagtcctctacatgcctagcacatcaagagtactcagtaaatgatagcagttgttttgctttcataggagactattactagctacttgatcttagttagttcagctttacttctttgagccagttttctcaactgtaagtggggacaataccaccattgaaggcaaggattttgcatggattaaattagattaggtatacaaagaatctggtaaaataatagaggcttaagaagtggtagtattactaggtaacaacctcttaggaaatggcagacatggaagatggggtgtctactcttctgtattcgaggccctttgagaagcctcaagcctaaaatgtagatggcataaaagagttcagagttatattttcaacccacaacctgtccctaccatgccaaacacctaggaagaggcgaactaacctcaaggtctaactcaagtctcattctgtccatgaagccttctgacaatcctaccccagttagctctcccttgattcacatattttggcacccaagattgaccctctaatgtggatgctagtttatagtattcacacttgtttcccatgaatatgacttatatcccccaactcagttttgagctcctagagggcaggggtcatttgtgtgtctttgtgtgtgtgtgtgtgtgtgtgtgtgtgttagagtgtagggttgggcacaaaagccctcacaaaacccccatattgaataccgttcaatttaggtttcagagagagaaaaagagagagacagagggattaattattttaaagcaggttaagtacatgtagagtacttcaaaaacagcctataaaagtcagctgggtctaacatttaagtcagtccagcaggccagcatggcacatgtaacgagcctatgtaacgagcctgcacattgtgcacacgtaccctagaacttgaagtatatttttaaaaaataaaaagtcagctgggagagatagaggcttatagacttagatcattggctcattcatctggaaaaacagtccaatccccatgttatactggtaaggaaatgatccgctgaaggtcacacagaaagttagttttagtattaatcatagaatccaggtttcttgactaccagttacattactctcccctttctgcctcaccagtttgatactgtggcttaactgtgactgagacacattagaggcaagagagaacaacatcggtgtcttcagccaagaaaatcctttgctgctacctcaaagctttacttgtaatgaataatcatttggaggtagcaataaagggcccaagaggaaatgaggttaatgatgtttgttttccaaggccctaggttcatgttcattaggatgtggctataacttgggaatgaatagggttcatattttagggatgtcatctggttcactcatcaaggcatggtttcaggtagacatgttttccagctctaacagtccagcatatcatttctttacaattactgccttcccctccacaactccgcctcccagcagtaaccagtggaaatggggcagcactctcagctctgctactctgtggggtgcagtgaggaagcaacatcatatggcttaatggtcctcaatcttggctgcacatagcatcacttgggaagcttttaaaaatacccatgctcaggatccatcctaatcaataaaactaggacgtatgagggtggggtccaggtactttacaattttaaagctccttacatatttctaatgtttcactagggttgaagaacagtggtagttgggactacataggtttcagaaatcagatggactgatcaactatgaagttacttttcatctctgagtctctgtttcctcagctgtagaacggagataatactttctgtcttgcaagattgtggccagtgttgaatgagaaaatgtgcataaagcactgagtacagtatcacagtacctggaacagaacaactgttcaataaaggttagctaaaaaaattttgccagtactattgtattaccattactattattattataatttataatttttatattaccaatgataacaaaacagcagacaactggaaaggcagtgggtgtggaaacaggaggtatgggtttcagccctcactctaccatttaacctatggttgtggatgaatcagtttacttttctgaacctcagtttccttctctgtaaaatggggataataagacctatttattcatctctctcaagcttattgtaaacattaagcagttatcgtctgggagagtgctttgaatagtataaagtatattagaagaattggattattattatcattttggttaattttttctgctgcaatgctgtatacccagtctgatgttaaggggaatgacatgtccagaacgtaagatgcagactaaatggagagacaattcatatgtgtgcacatgaatagtgttttgtttcttccttaattagaacaccaatcacactgtattatcattatttctttacatatatatcttgctcaccagaatggctagatggatgaattttttaaaaaacgtacatattaatatataagaacttcacgaacatttacatggatgtgaattacatatacctactagggtgttcagagggttgagattttagctgggtcttgaggaatgattataatacacaggagacataagaatagggacacatatagggcaagaagcaggacagagtctgacgcttacttacctctgctgtatactaggcattgtctataggtcatctaattgagtccttaaaatcaccttgtgaggagggtttttctttctttttttttaaattatattttaagttctgaagtacatgtgtacaacgtgcaggtttgttacatatgtatatatgtgccatattggtgtgctgcacccattaactcatcatttacattaggtatgtctgctaatgctatccctccccgctcctcccaccccatgacaggtcctggtgtgtgatgttccccttcctgtgtccaagtgttctcattgtacaattcccacctatgagtgagaacgtgcggtgtttggttttctgtccttgagatagtttgctcagaatgatggtttccagcttcatccatgtccctacagaggacaagaactcatccttttttatggctgcatagtattccatggtgcatatgtgccacattttcttaatccagtctatcattgatggacatttgggttggttccaagtctttgctgttgtgaatagtgccacagtaaacatatgtgtgcatgtatctttatagtagcatgatttataatcctttgggtatatacccagtaatgggatggctgggtcaaatagtatttctagttctagatccttgaggaatcgccacactgtcttccacaatggttgaactagtttacactcccaccaacagtgtaaaagtgttcctatttctccacgtcctctctagcacctgttgtttcctgactttttaatgatcaccattctaactggtgtgagatggtatttcattgtggttttgatttgcatttctctgatgaccagtgatgatgaacattttttaatgtgtctgttggctgcatgaagaggaggggtttttatactcatttcgcagatgaggaaatttacagtcgtagaggtgaagtacctgtctagggtcctacaacctggaagcagcagaacaagatctgaaagccaggtctacaaaactccagactctgtctcacttagaagtaagagtcaagggtttgccttaatggggcagtaggcagaccaatttgattagagtagaactgatagttaaaatccagggttactgcttgggacagtaatatgggaccagctcaaggagggccttgattttctgtgaaggagtttaaacttttatcttctacattttagagctgttgggaaagtctttaaagagcagaaaaacagtgtaaaaatacttaaattaaattttatagttgtatatgtagattcaatttagtatgtttttacatttactgtaaatatttttgtagaaaaaaatggatgaatataaagatccactgacacccttgcatagttatgtacatgtctatttcagtatggtcttcatcaggccatgagcactttctgtggacttttttttcacttgatattattttgtatgcctgtttttgttttgacctggtctaaatttttggcagttcacacataatatgtattggttaaatgcttgtatgaattgaattgtttgtttagcctttatggttaagtctgattttttttctgataagatgcatgtttttgtgccaattgctttttcttaagtgttttttttgttttgttttgtttttttgtttttttgcctcttggattagtccatttgggcctgttcccaaaagcaaaattactggatcaacgagtatgaaccgtctcatatgtatgattttgtacttcatccacattgttccagaatccttgatgccctctagataaaataagcccagttcacattgccaccagcaatgtgtgagtttacctgtttcactatagtcctactagaaccatcttatttaaaaagtgtttatatttattttgtactaactgacaaggaaactaaagacacagaggcaggaaagtgagttagaaaacaactataatagtcaaggcctaagtgaaaaggacctggatatcagtgatgatgaatttaagcaattcaaattcatcatcatcagacatttagtaagcacctactatgtacctggccctgcactaaacatattagtacctgatttaatcctcccactatctctgtaagataatatattgtggatctttattatatagctggggaaactgagacttagggaatggatatgacacacccaagatatctgaaactccagagctggggttcaaatatagactttctgaagggacagttgccagaaaaattacaaaaaaaaaaaaaaatagccagagttgttagtcaccaagaagaaatggaggccaaggaagttggcccaggtaactctcatattgggtgcctgctcatgagtagtgttctgtttggctaaccatccaagttcctggtatcattttctcttccaggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtgtaagtagggttgtacctcaaagttgactgaagtcctgtactaggccactaggaatgctttcaggatcaccatattaagggtatacagtgcacagccctggggcatccttcactttatagtctagggaaatatcataggccagccctgttgggagtattccactcaatgctcaaagctgagggatttctctaaagctgaaacctttgattcttagtacctgctaggagacccatttttcttagcttcctttatctctgtatggtgatattattaccttctgattttagcttccttggctcaggatattttttaaaaaaatttcttgttatttctactggttttaaaagtaatttaatgaacagattcattcactgtacttatgcttgaggcttttattttaagcaaagggtatgatttaaattttttttcaaaatgactttggttctccagagagtctcttacagggtgggagctgagctgatgtgcaacagaccttcctgaggctgggccgcaagccaaggaaccaaggaaggagcagctagggtgggaccacagcagtgctcagggaccagctttgcttggccacaacgcgcttgcctgtcctctctttatcgactgggaccattctcagtatactgcctcctggtcttcctttttcttgtctttcttgttttccataattgtaaaattggagaaaaagaagaacaaagcctccacagctttgactaattagcttactatatttacaaaaagccaacaattatactttgaaatcaagactggtttcatttatttcccccaagaagagcctgactcagcaacatactcagaccattctgaagcaatggggataaagagtgtcagctatggccttaggggtgcctatgggctctgggccatttcacatttgtatgtgtagggcctttgccagcaaaggcaggggctggcattggtgtcccatctggttcagagtctcctgtcctttctgttggccattggttctcacgtgtataccaaagcaacttatgggacttggttggcttctgtttgcagggtggcttccaggaccaggttttttgaaacagcttcccggaaaacaggaaggtaagatatggaggtgacaaaagaaaaaccaaatcgccttttaataactgcatccttagcatacaattgtgctcactctaacatctttctctttttgtttctctacagctctgtctctgtctgtcactttctcttccccaattctgtctctccatccctatctgtctgtcacctgttcacctgtgtgtctatttgtttctctcatattctttttctcacttggtgtctctgtccttttttttttttttttgagatggtgtctcactctgttgcccaggctggagtgcagtggcacgatcttggctcactgcaacctccaactcccaggttcaagtgatcctcccacctcagcctccctagtagctgggactacaggtgcacgccatcatgcccagctaatttttgtattttcagtagagacagggttttgccatgttggccaggctggtctcgaactcctgacctcaggtgatccatccacctcagcctcccaaagtgctgggattacaggcgtgagccactgcacccagccagtgtctctgtcattctcaatctctttctgtctgtctgtgtttctttgcctgtgtccccatagttgtctttatctgtctgtttctctgttcatgtcactctatatgtctctgtttttctcttcctgtgtctctttgtatctgttgtctctttgcctcttcatttcttcatctctctctctgctcatctttcccttttctctctcacaagcacatatgtctgtgcacacttgtgtgtgcatgtgcatgtgaacacacaccaagcagtatctcaaagactttacacccaatattttttgttagtttttttttttagtttacttttttgttattttacttatttagattccattatatactcaaagggcagctgacagggatatgtagaatattacactctaagataaacagccttagggcccccatttcaaaggtaaacattggacttaggcagtggttctcaaactggctgcacatctaagtcacctggaaacatggagaaaaaagtcacatattcctggatttcattctagacccactaaaacagaatctctagtagtggggcctgggaatatgatttttttgttttattttgttttttccttccctccctttcttcttttccattagtttgttattaaaacttctcaagtgctggtacagactgtccaaggcctggaatttaggaccctttggactagaacatctggagagatatttggttagccttcagggactcttttgtgagtttgttccttcttggttatcagagagtttgaaattgttcctcctaacaggtgacaggagcagaactcttctaggtggtcagttaaaagcagaacaatatacctttcccagcagtggagttggggtagattttccatcctctagtcaaaactatgggaactgacacactaggacatgattctgcacagcagttcattctagctctgattgtcagtgagccacctggaacctcaggctgggccaaattctccttagacaataatttaccattcattctaccatagcagatgaaagtcagatcaaggccccagatttctcttactgatagcatgaagataaaagttttcacctcagaagttttttaagtaagcttaatcaaatatctctcttgagaaaagaaaaagaaaagaagaagggagacgaagagagtctcaaatattcttaataaggtggcctatgccttcctagaataagccacttgagaaataaataacaaggaaatagaacgatgtaaactggaatgaactggatatgtctacaggaaagctttttagaggaggtgatatatgagttggggcttgaaaaaagaatagaactagacagaaaaaatgctgtgggggcagttattgatctgcaagcttggacaggaaaccaaggcattgagaaggaaatatgtaagaagcatgaagaaagtccaatagaacttttaaggcaggtagacttacaagagggaagctatagccaaactggtgttgagagtgtgaaaagattggtagccactaccaatgggctgggctttgtcagccagtgctcgaggaagccttagatcaagcacaacctacaagggctatggccaaagcaggcacttcaggctagaatatcactctacccaccctatgtctgggcttccagaacctagatttaatcctgttctttattcctagattccattttggcaggaatgtaggtaagaccaaagtaggtacacttgctctccagtatgtcatgaactaccatcctgagtacccacaggctcctcccactcagcatccacatagggaaagcatcccttccatctaggcctccaccttgtaaccaccacttgcatcagtgcttccacaggttggcctctgatcaagatcctcagaccagtcacatagtcagtcccgtctatggtcattgttgctaagttcttctctcatctctaatgaaaatgatgatctttttaaactttgtcttgcccctttttggtccccatttgtatacctgactacggcctagcgtttgaatgacatcacccccttattcatttcccttacacaatttaaacataaataactaagaagaaaatgagtagtggctcatcaagaacataaaggaggtgagaacatttcaaagaggcccgacagcttatggtttcagaagttattagtgttccactttggctagaatgtgggagtgaaaagagggaaacttagctgggggtgagaccagaaagatggattggagccagatcgtgaaggcattgtataacatactaaggtgcttggtctttatactgcagtccatatgcggatgagtcatagaaaggggggaagaatttcaagaatgacagtcacattctgagctgaccaagttgtaaaaagatcactttggtagtgggaaagatagatgggagagtaaagactggagaccagttaaggagactaattgtcctggcaagagttggggaagccctggcctatggcattcccagtgggaatggaacagaagggacagatttgagaaagactcaataagaccttgctacattttcaaacatggaacattgatgaaccgagaaagagaaaagtctaacttgggcacttaagtagatggtacaataattaatcatggagaagcaggttttatgggaaagatgctgagctcaattttggacacagtgattttgaagacacagttgttaaatttatacaaattttttaaagacactttgagacttaggtagagatagatgttcagtgggtaactgcaacttaggctagcagttggagctggatgtatgtatacatagatttgggggttagaaatatgagtatagccactatataagtctggggagtggggctagtcacatatgctacaatgtgaatagtagcctgttgtggggaggtccctagtatttggtggcaattgaagccatggatgggaataagatcctccagggagtaagtgtaaacagactggagagaagagaaaaacagaaggttgaggacatagccctggggaccagctgttgtacgtaatgctctggccacactagagtgggtttcatttgccaagattttctcctccccaagctgtccccagacatgggtaatttagaactaatccaagcacatcaagaggctggacaaggttggtttggtcttctaggcaaaggaggattcatctttcacatggtacttgtctgtgtcctcacccttatccctgttagagatcatcacagaatgtagttcgtggtctgcagccagcttccctgggttctccaagcttcacatagtctggtactcagagaattgttctggcacctgaaagatgtcttcacatctctttaagcctgccagagaaggagccccaactataagcatggagctaaatgttttgaaacatctgggctgaatcacttctccatttttcaaatggcctctttagcactggcctagaagtgtcccccattcccccaatttacctttccagtcctgatttctagaatcttagtgaaacgtctttctttatccacagttctcaaggcagacttcctggagatgaaagttgaggctacaggtatgcagtccccatccctgattacaaaatcttgttccacataagccttcattacgggatctgatattttgaggactggaataacatgtagatcagaagggtgggaactcacttctacgcctcagttcattactctatcactgcctgacccttaaatttagtgactttcaattccaaggttttgtgtgattttaagtaaccttcctctttcatttctttttctcctagccaaactatggcacgcttttacagattgcctttgaatcaaatttattaagaatcctaggctgtgacattttgggaaagtacatttacttctctgagcctcagtttcccagtttctaaaatgagaaggttggaaccttctaactctgacacctctcgggcctttaaggaaaccaggaacatgctttctgatattataacagatgccaagaggctaccttagtgtctgtagatggattcattcctgcagaccaaatcattatttcagtcttacccacctgaaccttcattcttagtcctttatgtttgtccaatgcaaagcactttcacattcattatttcatttgatgcatatcacatgccaggagaagggaggataatatgtgttctaactcaacaaataaaggaactgaagttcagaggggataagtgacttgcaaaggtcacaggagactcagaggtcagggaaattcctttctctatcataggagttctgattgtttgactatcagattgctggcatgatgtgacctgataacacacataaatgagatccaagtatctggagcttggcttttcatgtgctccctaaccttctttttttccctgtcactgccagtcctcagaggtccgtgggtagataagcttctccttatcagcccctatggaggtgaagtccctgttaaaaggaagtttatagttattgtatgaccataaaggcagtgggcatgatgtgggaagaaatctcagaggttctagtatcaggcttctatttctccatgtagattttggggagtttgagttgaggtcaaaggcacaaagtgtccagccctggtcatagcaccatcttaggcctgtttcatgagatttgacttgtaagagcctttgcccagcaatccgctgttgctcagaagatgagctaccaattataggcttagctacctaccaagagaagccccactgatcagtggctgttaagtacttgaccagtcctcgctaattccctactctcttctttctctttcaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagtaaaatactctttttacaatccatataagcccttgattggaagggcttttcaaaatcatttagtctaacaactgcccagtttccagtcgggggaactgaggcagagcaaggtagtgatcacaccagtacaagatctcaggtcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatata

SEQ ID NO: 3433 - DNA, 54193 bp, human
ttccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctga

SEQ ID NO: 3434 - DNA, 341443 bp, human
ttccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaagaactgagtttatgacttatagatcctcaccaaggaaacttccaaaagatgtacttcacagaagaagaaaatgatcccagaaggaaaatttgagatgtaagacagaagaacaagcaaagattgtttaaacatgtgggtaaatataaacaaacattggctttataaaacaataataatgtctaatttgtaagttaaagaaaaactatatagaaagaaaataccagacaataacatgatacaaaccagcaggggatgatccaagttcaggaaaagattgttcatgaatatactaaccttaaaacttaaatatacatgctgtaaattctagggtgaacaataaaatagtagaaatagagtagatagctttcaaagtaataggagtgaaggggatcctcaatccataacagtggggaaaaaggaatatgaaaagaaatatagaaaaagtgggagaaatacaaagcacaaaatgagctggtatgtatataatcacagtagatgtaaatggactaaattctctggttaaaagacaaaaattatcacacttacaaaataaatttaggcatatgctctctataagacactcatctaaagcataagaacacaggaagattaaaacccaaagaataaaagacaaatactaacaaaaaactgagatactacattactatcagacaaaatagaacttaaggcaaaaagaataaagtaggtttctacttaaacatggtaaattaaccacgtttctgtcatttagtaggagtttgtgagatatttgagataaaaatgataagaatccatgaggacaaagagaacaggagaagaaacttcaattcatgagacagtttaatacatattgaagagaataggtagaagatagatgacagcaagtattagttatctacggctgcataacaaattactccaaaacttagtggcttaaaataacagtacttatctcacaccattcctgagagttaggaatctggaagtaatttacttggggattcctggctcaaaatttttcatgaggttgctgttaggaagactacagtcatctgaagatttgactggggctagaggatatgcttccaaaatggctcactcacatggctattcgcaggagtcctcagttctccaccacatgggcctctccacaggttgcttgagtaccattatgacatgttacctggcttcctccagagcaagtgatccaaaagataaatgatgaagacacagtagtaccttttatgatttagtctccaaagttgcataccatcatttctgctttattctgttcattagaagcaaggcattaagtccagctcacattcaagagggaaattaggttttatttattgaaggaaggaatatttttaaaaagttgtgaacatacatattttcttgagacagagtctcactttgtcacccatgctggagtgcagtggcatgatcatggctcactgcagtctcaacctcctgggctcaagtgatcctactgcttcagcctccccagtagctaggactacagtcatgtgccaccatacccagctattttattttatttttttgtagaatcaggatctctctatgttgcccagtctagtcaaacttctggcctgagcaaacccctctcctcggcctcccacagtcctgtgattacaggtatgagccactgtgcctggccaagaacatattttaaaacaaccactgagtggcaactgagtgaagtagagtaactacaacacaaatgcctgcataatgtggtacttactagaaggagccaattggccctgtataacccctgagagatttgtaacttttaagcactgaatccaacaagaagccagggaaatatgcagggctgaaaacaatagccttgactaaaaatccatgtaggaaatagttggactctcagatcccctcactctaacacacaccacaacagcaccaccactaggaaagaaaatagatttttattttctgaaaaaaaaaaaaaatagatgaatatctctatggtaaaattaatagatggtaaaccaggggatactgtcctgccctcaaattggtacccagtgaattgtgtgcctccatcctctctcttgcctctcctgcacagtaaggaaatacaggattcttaagaaattaaatggccagagaaaggacctccagatactgatatttgagactcccctaaacaaataatcaccttgccttcaatgaccctaccatatggtctacccattgacaagctccaatcatgtgcacacaactttcagtcagttttttattgattcattttttaacatgaacatgtaggcaaggattactacatagctgaggaagcctcaaacattaaagatagggtaaacaacagccaaacagaaaagaagaacttgaaaaaaatagacaataaagcaaacagaagaaaagtgtatatatatatatacatatatatgtatatatatgtgtgtgtatatatatatatacatatatgtatatatatgtgtgtatatatgtgtgtgtatatatacatatatgtatatatatgtgtgtatatatgtgtgtatttatgtgtgtgtgtatatatgtatttacacatatacatatgtatgtatatgtatgtatgtgcatctacaggtgtatgtatgtgtgggcatatatgtatatacatacatatgtgtatgtatatgtgtgtgtgtgtatatatattctgtgcaaagtgagagagggaatagttgtgtactagcttaaatattgcaccattttgtattttgagatggttgaaatggaaccaagcactaaaatttgaaacgatcttatacacatgcaaaaactggcagcttttcacatgtagcattatattgacattttacttgacttcctaagccactagtgaattaacctggcttctttgtattcattattttaaagaatgtattcatttgtttttacatactaatgttagaagtaggtgctggggtagagctaacttaattgctctctctctctctcagtgttgttattcttttttaaaatgtttgttttatagaagtataatttacatacagcaaatgttgccttttaaatttttaattttaaaattgtactattctgacacaaccaaggaccctcacagagtccacttcactcccctgctaactccactggagcaggtgctggtactcacagctgcaagaactgaagatggatcacacctgaaaattgatgcactctttgcagacactccctagtaccagcccagagcccattagctccactgggtggctggacccagaagagaaataacagccactacagttcagctctcaggaagccccattcctaggggacagggagaacaccacatcaagggagcacctcgtaggacaaaagaatctgaaccatagcccttgaatcccagatcttccctctgacatagtctacccaaatgagaaggaaccagaaaaacaattctggtaataggacaaaacaatgttctttaacacccccagaagatcataccagctcacaagcagtggatccaaaccaagatgaaatctctgaattgccagaaaaataattcagaaggtcaattattaagctaatcaaggaggcaccagaaaaaagtgaagtccaacttaaatcaaaaacatggccaggcacagtggctcatgcctgtaatcccagcactgtgggaggctgaggcgggtggatcacttgaggtcaggagttcaagaacagcctggccaacatggtgaaatcccacctctactaaaattacaaaaattagccaggcatggtagtgcatgcctgtaataccagctactcgggaggctgaggtatgagaactgcttgaacctgggaggtggaggttgcagtgagtcgagatcgccactgcactccagcctgggtgacagagcgagactccatcttgaaataaaaaacatgatacaggatatgaaagaaaaattattcagtgaaatagatagcataaataaaaaacaatcacaacttctggaaatcaaggacacagagaaatgcaaaatgcactggaaagtctcagcaatagaatcaaacaagcataaaaaagaacttcagagcttgaagacaaggctttcaaattaacccactccatcaaagacaaagaaaaaagaatttaaaaaatgaataaagcctctgtattagtcagggttttcttagacagaactaatagggtatatatataaagtttatacttaataaactcccatatatatacatacatatatatgtatatatagtgggatcacaaggtcccacaataggttatttgcaagctgaggagcaagaagagccagtccgagtcccaaaactgaagaacttggagcccaatgtttgaggacaggaagcatccagcacgagagaaagatgtagactgggaggctacgcctgtctcttcttttcacattttcctgcctgctttatattcactggaagctgattagatcgtgcccaccagattaagggtggatttgccttccccagcccactgactcaattgttaatctcttttggcaacacccacacagacacacccaagattaatcctttgtatccctcaatccaatcaagttgacacttagtattaaccatcacaagtccaccccttgtcaacttgaacccatacacatctcctgagatcattcataatcttcaaataaagacaatgaggtcataattacacctaacataatacaactgtccttcgtacaactggaattgcaccaatccccaactcaaatactattaaataaagttaacacttaaatgctgatacgaagtcagtaagtcttacgtcacatgataaaggaaaaggaaataagatgaagatattttcttagtacaagtatataaatgcaccaacatgtttttaacaaaagaagtaggaaatattcatgacagttacagtccccgtttctgcagctggtcatgtggtcgtagctggtattgatgactaccttcttctactacccattctgtattctctttgccttcagcgagcacctcagcaggtcatggcttttttcctggtggagtgactcaaaccttcattcctggagggtctgggtcattcatagtcctgcctggattgggctgttgtagtttcccattgaccttaatcacaaggtatggtaatgctaagagacgccctaatggatctcctgtattccatgcatactcttccttaccatccttgtggagtagtagacttatttcatgttgatagcctgggtcaaccaccccagccaacactgtaactccccttttaccctgttgacttaagattaggaggagcctaaagtgtccaggtggcaatcttaacttccagtttaatggaatcattgttatgtctcctggtggcagcgttcttccctctagaactaagatctctaggccagcagaacgtaatgttgcgggaacaggaggcaaaaattttgctagtggatcactaggggtgatggtaagtggtgccacttccacttccatctcttgattcctggacctgtgaattctggctatgggagaaatagtaccatatattggatgctgattcagagcatacacggccttatggagaactttgccccagcctggcacagtgttgtcacctaattggcattgtaatcgtgacttcaaaaggccattccaccgttctgtcaatccagctgcttcaggatgatgggaaacatggtaagaccagtgaattccatgagcatgagcctactgcctgccgcacttctttagccataaagtgagtgcctcggttagaggcaatgctgtgtggaatactgtgatggtggataaggcattccgttagtccacggttggtagtcttggcagaagcattgtgtggaggataggtaaacccatatctggagtaagtgcctattccagtgaggacaaacctctgccctttccataatggaagaggtccaatataatcaacctgccaccaggtggctagctgatcaccccaaagaatggtgctatatcgagggctcagtgttggtctctgctgctgttaaattgagcactcagcagtggctgtagccaggtcagccttggtggatggaagtccatgttgctgaacccatgcataacctccatccctgccaccatggccactttgttcatgggcccattgggtgatgacaggggtggctgggaaaagaggctgagtggtgtacacagaatgagtcatcctattcacttgattattaaactcctcctccactgaggtcacctgttggtgagcattcacatgggatacaaatatcttcatagtttttgaccactcagagaggttcattcgcctacctcttccccaaatttctttgtcaccaattttccaatcatgcttcttccaagtccctgaccatccagccaaaccattagctacagcccacaaatcagtgtataatcgcacatctggccatttctccttcatgcaaagtgcacaactagcattgctcgaagttctacccactgggatgatttcccttcaccactgtccttcagggatgtcctagaaaggagctgtagtgctctagcttccactttcaggtggtgcctgcatatcatgcagaaccatctgtgaacaggctgtaatcttctcttcctctgtcaactgatcatagggaactcctcatgaggccattggtgcaggctgggggagagaaggtagggtggcaggagtggagaccatgggcatttgagccacttcctcatgtaacttacttgtgccttcaggagctgcttgagcccaatcacgtatataccacttccatttaatgatggaatgctgctgtgcatgacccactttatggctagatgggtcagaaagcacccagttcatgataggcagttcaggtctcatggtgacttgataacccatagtcaaactggaaaagcccagtctctctggccaagagctgtctctcaaaaggagagtagttatctgcagaagatggcagggccttgctccaaaatcctagaggcctccattgtgattcacctgtgagagcccgccaaaggctccaaacagcatccctaccagccactgacacttcaagcaccattgaatctgctgggtcatatggtccaagtggcagagcagcttgcacagcagcctagacctgttgcagaatcttctcctgttctgaacttcactcaaaactggcagcctttcaggtcacttgataaataggccagtgtaatacactcaaatgaggaatgtgttgcctccaaaatccaaataagaccactaggcattgtgcctctttcatggttgtaggaggggccaaatgcagcaacttatcctttgccttagaaggaatatcttgacaggccccacaccactggacccctagaaattttactgaggtagaaggttcctgagttttagttgaatatatttcccatcctctggcatgcaaatgtctcaccagtaagtccatggtgtttgctacttcttgctcactggttcgaatcagcaaaatgtcatcaatgtaatggaccagtatgatatcttgcagaagagaaaagcgatcagggtctctccaaataagattatgacacaaagccagagaggtaatatactcctgaggtaggatagtaaagtatattgccggccttgccagctgaaggcaaattgcttctggtgggccttatggacaggaatggaaaaaagggcatttgccaagtcaatggctgcataccaggtaccggtagatgtgttaatttgctcgagcaatgaaaccacatctggtacaacagctgcaattggagttaccacttggttaagcttatgataatccactgtcattctgcaagatccatctgtcttctgcacaggccaaatgggagagttgaatggggatgtggtgggaatcaccacccctgtgtctttcaagaccttgatggtggcactaatctctgcaatcccgccactgatgcaatattgtttttgatttactattcgtctaggtagaggcagctctaatggcttccatttggcctttctcaccatagtagccctcaccttactagtcagggagccaatgtgagggttctgccagctgctaagtatgtctatgccaattatgcattctggcactgaggaaatgaccacaggatgagtctggggacccactggacccactgtaagtctgacctgagctaaaactccattgattacctgacctccataagcccctacttgacgttttgggtcccctggaatcaaggtcagctcagagccagtgtccagtagtccccaaaatatctgatcatttccctttccccagtgcacagttaccctggtaaaaggccggaggtctccttggggaaggagaggagaaagattcactgcataaattgtcagtaatatagtggggtccttcctcaaggggacccagcctccccttcattcaaggggttctgggtctgtaaacgggctcaagtctggaaattgattgaggggctgtgattcaaattagttttttgtccatttgacctagaagttttctgtttgtgtaatttaagtaggaatgcagtaggcttcctatcaatttcacttctaggaacaccatgattaattagccaatgtcagagctctccactagtcagactattctgattgttgctttgcctctgctgtccattatggtagccatgcccaccttgcctttcatggttgagtgctgtcacgtggccgctgccacctcaggatccaattattcccattgtatttgaattttgtagttgagtgactatggttcccaccattagatctgacatacagagaagagcaattacagggctattcaaagatgcaggtgctgccctcacaaatctattttgcaaggcatcagtcaagggtatagcttctggaccctcccagctgggatgagtaagtctaaagtaactaatccactccaccatcccaatctccctaagcctttggatcccttcctctacattaaaccaagaaagatcaggcatttccagctcactcatggtgggccatcttttaatccatatttcagctaaccaagcaaataaactattataaccttttttaactccctgagctgcaacattaaaagcagagtccctacttagtgggcccaaatcaataaattcagcctgatccaactctatgtttcttccaccgttatctgatacccttaatatctattcccatgcttgttctccaggtttctgtttatattaattagagaactcaaacagttcttttccagtgtagtgcacctcctcatgggtcacactctcaaacttacctctaggggcccgccgggagtttagtctagttataggtctagaggcaaacagagatgttgggggtggtttctgaggagaatcaacattatcttgcctggcaactgcctcaggggaggccattactgttgcctcaggcagtgcagggtttatctcctcaaaggtggacaagctgatggcagcataggtcagggaggggacgttgccactactagggatggggaaactgttccttcttgcaaaaaaggttcatcagagtttgcaaactcagtgtgcccagcttcatcagggtcctcccacgcatccccattccaggttgcagggtcccattttttttccaatcaatgccctcattttaacagtagatacttggcaaggctgtgcatgcatctttcattgtaggtcaaccactcgtatagtaagagcttgtgtctgtttttccacagtttcagctctttctctgcaggagataagactctcactcagggcaatcttagcagatttgcggctcagtatctgcttctgaagtcaggtgacagaatccctgagttcattttctttcatcactttttccactgaacttaggagcaaccaaccagcttcattatgttccttggttctccacatatggtcaaaggtattatgtatagagtcattgagctccttgcctctcatgagtggtgaatcagaagtgtcaaatgcatttattttgcataactctctaaacagtttctgccaaggactattaatgttctccatactattagaagtagagtccttagcatttttgagtctaatcatattaagcagccaactccagaaaccccaaaaccaacaaaagaactccatgcttaatattctgtttctctagaaacactcctggtactaaaatctgtattagttatggttctttcagagggacagaactaacagtatgcatatataaaggggaatttattgagtattaacttatacaatcccaaggtcccacaataggctgtctgcaaactgaggagtaaggagagccagcctgagtcccaaaacggaagaacttggaacttggagtccagtgttcgagggcaggaagcatccagcatgagaggaagatgtagactaggaggctaggcccgtctctccttttcacatttttctgcctgctttatattcactggaagctgattagattgcccactggattaagggtggatctgccttccccagcatactgactgaaatattaatctcttttggcaacacccacacagacacacccaggattaatactttgtatccctcaatccaaccaagttggcactcagtattaaccatcacatcttccaagaactttgggactatgttaaacatccaaacctaagaataactggctttctgaggaagaagagaaacctaaaagtttggaaaagatatttgaggaaataattgaggaaaacttccctggccttgctagagagctagacatccaaatacaagaagctcaaagaacacctgggaaattcatcacaaaaagatcatcacctaggtacatagtcatcaggttatctaaagtcaagacataggaaggaatcttaggagctgtgagacaaaaacatcaggaaacttataaaggaaaacctatcagattaacagcagatgtctcaacagaaaccctacaaggtagaggggattggggtcctgtttttagcctccttaaacaaaacaattatcaatgaagaattttgtatctagtgaaactaagcttcataaatgaaggaaagatacaatcttttccagacaaacaaatgctgagagaatttgccataaccaagctggcactacaagaactgctaaaaggagctctaaatcttgaaacaaattctcaaaatacaccaaaatagaacctccttaaagcataaatctcacaggacctatataacaataacacaaacaaaaaaacaaagtattcaagcaacaaatagcatgatgtatagaatagtacctcacatctcaatactaactttgaatgtgaatggcctaaatcctccacttaaaagatatagaatggcagaatggataagaattcaccaaccaagtttctactgtcttcaggagactcgcctaacacataaggactcacatgaacttagataaaggggtgggaaaagataatccatgcaaatggacaccaaaagcaagctggagtagctatactaataacagacaaaacaaactttagagcaacagcagtttaaaaagacagagcaacattatattaatgatagaaggactagtccaacaggaaaatatcacaattgtaaatatatatgcacctaacactggagctccaaaatttataaaacaattactactagacctgagaaatgagatacacagcaacataataatagcgagggactttaataccctactgacagcactagacaggtcatcaagacagaaagtcaacaaagaaacaatggacttaaaatatgccctacacaaatagacttaacagatatatacagaacattctacccaacaactgcaaaatatatattctattcctcagcacatggaacattctccaagatagaccatatgataggccaaaaaaaactcaacaaacttaagaaaattgaaattatagcaagtactttctcagaccatagtggaataaaattggaaagcaactccaaaagcaaccctcaaaaccatgcaaatacatggaaattaagtaacctgctcctgagtgatcattgggttaagaacgaaattaaaatggaaatttaaaaattctttgcactaaacaataatagtgacacaacctatcaaaacccctgggatagatcaaaagcagtgctaagaggaaagttcataacattaaatgcctacatcaaaaagtctgaaagaatacaaatagacaatctaaggtcacacctcacagaactggagaaacaagaacaatccaaacccaaatccagcaaaagaaaagaaataacaaagattagagcagaactaaatgaaattgaaacaaacaaaaaaaatacaaaagataaatgaaacaaaaagctggttctttgaaaacataaataaaattgatagaccattagtgagattaatcaagaagagagaagatccaaagaagctcaattagaaatgaaatgggaaatattacaactgataccacagaaatacaaaatatcattcaaggctactatgaacacctttatgtgcataaactagaaaacctagaggagatggataaattctaagagagaattgaaatgataatttaaaaattgccaacaagcaaagaatccgggatcataaagattcacagctgaattctatcagacagtcaaagaagaattggtactaatcctatggaaactattccaaaagatagagaaagagggaatcctctctgaatgattctatgaagccagtatcaccctaatgccaaagccagcaaaggacataacaaaacaagaaaactacagaccaatatccctgatagatgcaaaaatcctcaacaaaatactagcaaaccgaatccaacagaatatcaaaaagataatccatcatgctcaaggtggtttcatacaagggttgcagggatggtttaacatatgtaagtcgctgggcacggtagctcacgcctgtaatcccaacactttgggaggccgaggcaggcggatcacctgaggtcggaagttcaagaccagcctgaccaacatggagaaaccccatctctactaaaaatacaaaaagttagctggacgtggtgacacatgcctgtaatcccagctactcaggaggctgaggcaggagaatcacgtgaacccgggaggcagaggttgtggtgacctgagattgtgccattgcactccagcctgggcaaaaagagcgaaactctgcctcaagaagaaaaaaaaaggaaaagaaaaaaaagtaagtcaattaatgtgatacaccacataaacagaattaaaaacaaaaatcacacgatcatctcaatagatgcagaaaaagcatttgacaaaatccatcatccctttatgtttaaaaccctcagcaaaatcagcatacaagggacataccttaagataataaaggctatctatgacatacccacagccaacattatactgaatggggaaaagttgaaagtgttcttcctgagaactgaaacaagacgaggatgcccactttcaccatttctattcaacatagtactggaagtcctagccagagcaatcagacaagagaaagaaagaaagggcatccagattcgtagagaggatgtcactgtttactgattatatggtcatatacctagaaaaccctaaagactcatccaaaaacctcctagaactggtaaattaattcagcaaagtttcagaatacaaaattaatgtacacaaatcagtaggtctgctatacaccaacagcagccaagctgagaatctaatcaagaactcaacccctttcacaatagctgcaaaaaaataaaatacttaggaatataactaaccaagcaaatgaaagacctctatgaggaaaactacaaaacactgctgaatgaaacaataaatggcacaaacaaatggtaacacattccatgctcatggatgggtagaattaatattacgaaaataaccatactgccaaaagcaatctacaagttcaattctcatcacaataccatcatcattcttcatataactagaaaaaacaatcctaaaattcatatggaagcaaaaaagagcccacacagccaaagcaagatgaagcaaaaagaacaaatctggaggcctcacaatacctgactttgaactatactataaggctatagtcaccaaaacagcatggtgctgatataaaaataggcacatagatcagcagaacagaatagagaacctagaaataaagtcaaacacttagagccaactgatcttcaacaaagcaaacaaaaacataaagtggggaaagaacaccctattcaacaaatgctgctgggataattggcaggccacatgcaggagaatgaaactggatcctcatctctcactttatacaaaaaatcaactcaagatggatcaaggacttagaaatctaagacctgaaactataaaaattctagaagataacatcagaaaaacccttctagacattggcttaggcaaatttacttcatgaccaaaaacctaaaagcaaatgcaacaaaaacaaagataaataagtgggacttaattaactaaagagcttttgcatggcaaaaagaacagtcagcagagtaaacagacaacccacagagaggaagaaaatctttacaaactatgcatctgacaaaggactaatatccagaatctataaagaactcaaacacatcagccccccaaaaaaccaaagaatcccatcaaaacataggctaaggacatgaatagacagttctcaaaagaagatatatataaacagccaacaaacatatgaaaaatgctcaacatcacaaattatcaggaaaatgcaaaccaaaaccacgtgataccaccttactgctacaaaaatggccataatcaaaaaatcaaaaaataagagatattggcatggacatggtgaaaagggaacacttttgcactgctggtgggaatgtaaactagcacaaccgctatgaaatacagtgtggggactccttaaagaactaaaagtagatctaccatttgatccagcaatcccactactatgtatctacccagaggaaaataagtcattaagcaaaaaagatgcctgcacacgcatgtttatagcaacacaatttgcagttccaaaaatatggaaccagcccaaatgcccatcagttaacgagtggataaagaaactgtggcatatatatatatatggtgaggtataaaggattacacattgagtacaatgtacactgctcaggtgatgagtgcacaaaaatcttagaaatcaccattgaagaatttaataataagaataaaatataagaataaaataaaagaataaaataaaaataatacaataaaaaataataaaaaaagaataaaaataagaaatgtttaaaaattatactattctgagagtttgggcaaatacatacagccatgtaaccatcacttcaatcatcatgtaaaaccattgatcatcttcctaattatcccagagatctttttatagtcaacccttacccctgccctcagctcttggtaactacttgtctgtttcctttccctatagttttgccttttctagaacatcctaaaaatgcaaccatggaatatgtaggtttttgcatctggccttttttcatttagcacaatgcatttgaggtttatctgtgctgttgtacattagctttctatgccttttcgttgcttaataagattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatctaagaaatctctcccaaacccaaggttacagagattttctcttatttttccttctggatattttataggtattacatttatatctttgatttattttgggttaatttttgtatatggtgcaaagcatgagctgaggttcatcttttttgcatatagataacagttgttcaagcaccatttgttgagactattctttccctattgaattactttgacatctttgtcaaaaagcaattgaccatatatgtgtaggtctatttctggatgctctctttgttcccttgatctatgtgttcattctgttgccagtaacacagacttgattctctcctctaactttgttctttttctttttctttttttttgaaaagatacagttttattaaacaaacctggaatcaacagtatattacataaattagacagcagtaaaattttcctagggcatatgtacaaatcacagtgatttccattgtgcaacagacaggattaaaaataggcactcccctccccgaccccccatgagaaggcggggtcacccccgcagggttcccagttctggctcgccaaggggtgcacaaacctgcaaaggcactttgcttgtgtgcgcggcaacaggggccccagaagcacgttggcaacatggtgaggctgcccagtgttcagcgcaaaaaaataattcagctatggcagctgagcagagctcaacagccatctcagaggacaaggactgtggaaaagcttcaaatctcatccgctaaaacacaattgcaatgccatttacatgcagaacagacgtctccaccatggaagatcaaactaagcctgaacagaacttcccaacacatgataatttacagaaaaccatgacagagcatccctgctattaggaaggactgttctgcggggtgcaaggccataaggtttgcaaagcaaacttgattatgaaaaggcttggtgaaaatacagcccctcaccttcaccaagacacacacacacacacacacacacacacacacaccgcaaagaaactatccaaatgcattaagacacctgttcgtgtgcttttcttcttgcttttgttaagtgaatcccatccgtttaagttagactaattagaaggccttcttgcctccgtcggcaacagagaaaaacagtgcatacgactcctccaatgtgtgtaaaatgcatgctaggtagattgaaggaaaaatgagaggaacccgggcaccccacttcaaatctcatgtttgctgactataaaaataaatcatagtaatattattgaacattctactttgttctttttcaaaactgctttggccattctcgttctttgattccgcgccgccccctccccgcccccaaccgctcccgccaagccttcaaggtactgttcagctcttagtggctagtctggaacctgcactgtggactactgcttagttccgttctcgaagtctttcatattgctgtttaggatctgatccttgcatttgcaacttggggatgagcccagggatttataagcaactttatggaattgctttcctgatcttctccctctctacagtctctcagtcctttcctattccttgttgctgttctttttggttcttcagccatagtgatagggctttagttacctgtttctgtcacatactcatcactactttatctgcgtccagggccaagtggctgtaagaaagaaagaaaaaatataatggtgatcaactcaccctcttgagacctcagctcctccaacaggagagaaagttcgccttccctcagttttaggcaactacagcatccctgctaatgctgatgctgccattaatgctgctgcctctataatggaaatgcttataactaggtcatgagagtatggaaaaaggaaccaaaaaaacacacagagtgtttaccccactgtttcctcctcaaaacagaacaagaaatactgctgtttctttaagaggaaaaggaagatggcatacctgggctggagaaaaattttctccacctacccgttgtttctagcagtatggcttcctcttcctctgtgcctgtgtagcctccatccccagctgaacatgggtgcaggttcctccttccctgcctcctgtgaagtttcactataggccacaaactgtgaaaaatctaaagtcaactctccccatgtgttggtattcttactttcttggcaagcaaattctgttctccaaaacagtagtagtaggacaacaagttgttcttagcaaaggaaaaaaatcactttattgttattttagtttttttaaaaaaccaataaagtggcatattgtatctgattatattgggaggtttaccatttttttgttctgagggggatgggaccaaccaagccattcacaacgaacatgggttcagaggagtttctaaatggaaagagattaatctgtagcacccagaagataagccaaactatgtcattttgagtgaacagtcaggttggcaaggcaatgtacttgaattttcattcaccttttcagctaccaaagaatgtttctacccgtctcttgacctaatcatcctgcagtttggaaaatcaaactctccaatacatgagatgagccaacagagccagaccatgaccaggagatagctcatcccagagaaggacatgcttaacaacaacaacaaaaaattcaaaacatctatttcctccactgctggggactttcaactagttaggcatgtgacttcctggtgactcaggggacgaaactagtgatgaaacagccaccaccatattgccagtagtggacaaaaagagaaggaaagtgaatctgccttacaactgccagaagaacctcaggatttggcatcatcgggtcagaaaaggaaaatccatgtgttgtccttctaccccagtagctgaattatagcattttggtctcctggtatacctcacattgggcagaaatagctatattagcatggatcatagttactgggctttacctgttcccattgggccttggttagggaatatcacttcgttggcttcaaacatgcttatctcacatacagattgtaatctttcctttcttttgggaaattttcctgtatgcaaaacatagagtggcagggagatgcaatgtcatgccccttctccacaaggactttggatgttggactttgctttcttgccattacctagtggttaaagccccatcattgaaatttacatagtttctcaattggtatttgggcaactctaacttcccatgtagaaactttaacttccttatccctgtatagaaaaatccttgcctttggcaagggggagtggtggcaaagcctgacgcatcctgacacctcataccccacgaagtgccttgcctccacaagaaaaagcaaagccagtgaccagtttggctgcagggccagcccctttgcaactagctttccgacatttttgttttaatttttttttttaaggatagctcttaaggggttgatcctgagaggttgggcagggggcttccttcctaatgcactgttctcactctccaccaccaccccccaaaaaaaacctcttactagatatttggccttcgtaacaaaggtaaagagccccaggtccctttagcatgcagagtaatggggatccctccagggccattggcacttcaaggtggtcccagactcataggagattctgttgtcatctttcttaaataaatttgaatacctcagaagtgatttggtcaccagttcagtcctcaccaacacatcacaggactccctccttagcccagttgccatagttgcttagctatattcctcagccagatccttggaattgatccctcccactggcccctatccactcaaatccatttgctctgtggtttttgagctgtctccatttcaatgctgcattagtccattttgcgttgctataagagacacctgagactgggtaatttgtaaagaaaagaagtttatttggttcatggttctgccaactgtacagacatggcacccacatctgctcggcttctggcaaggcctcaggaagcttttactcatggtggaaggtgaagggagagtaggtgtgtcacatggcaagaaagggagtaagagagagggggtggtgccaggctctttttaacaatcagatcttgtggtaactaatagagcaagaactcactcattaccacaaggacagcatcaagccactcataagggatccacctccatgacccgaacacctcccactaggccctacctccaacattggggatcacatttgaacatgaggtttggaggggatgaacacccaaactatctcaactgctgtgatgcctgaggatctttttctttgggattgatgcaattgttttttcttaatttagcatctgtttattgaaaaaaaaactagccttaatattataccattaggagttctcctaagccatacagtccttccagcattgcattctgagcagattgaggcaagcaggctaggattccatggagttataaagagtcttcccttggtgaacagagcatgactcatgtctatgcagtctaagcatgtaagggttgatcagttgctatacataccttggtgcttcccagaggtctcactccagactgctctgcaaatgtggatagagtacaccagcacccagtgtgcattcatgattgccttaatgaacattctcttgctatttttggtctgtctaggagtaaacagggtctaagaaggtgcaagtcaggtgactaggttagcctccaattgaagttccattttatgaggtccccagtagaagtgttgattgcctgtttagtcacagtgagctttaagtacatagaaacagcccctgtctattaggcagaaacatcatcctctaaagtaacttccaacttacttcagtggaaatatacactggtggcgcatattcagtgtcaattctcagtgtttgtaactacttttttttttttgagacggagtttcactcttgttgcacaggctggagtgcaatggcgctatctcagcttactgcatcctctgcctcctgggttcaagcgattctcctgcctcagcctcccgagtagctgggattacaggcatgcgccaccatgcccagctaattttgtatttttagtagagacggggtttctccatgttggtcaggctggtctcgaactcccaacctcaggtgatccaccccccaatcccttggcctcccaaagtgctgggattacaggcgtgagccactgcacccggccctgtaactacctttaatgccagaaatataaaatgtgatgctgttaagtcaaagcgattactaaagatcgcaagcttaatttttaatgtaaatatataatctgttccccctcctagtgagcaagcatggcctacatttctcaagtataagtactttcatggcagcctataacatatctcctcaaaggaactcgatctttcttctgatgcatgtctttcaagcccaatgcctactgtgtcccaaccacctcttccattttcatatttcagtttttcattcccagtgagttgacctgacaatgttgttttgagtgtcagagccatgttagggccagagtttctcagatcaggaactcgtagtaccatacagccaaattgcctttgccaggccactgccaccattaccaccattgactcaaggtgggcagatgaattctagaaatccttagggagccaggataactgggtacccaatttggattgaccacgtgggcaacaggaatttgtctctaagattcttgcctttattgactccccggtgctgtgggaaagtcctatctatacgttgatggccagtgactcccaatcttccccatgatgggttggcagaaatctaattgggatttctttggttttgtttccttagacttttttaatgggaggtttattttgtttctgaataagaaaaagaaaagaataccatggcccttatgaaggtttatagagttttgagcagtatttcagccataaataagcaatcttagaagtctttgatcaactaagtagtcttaaaaatatgctttttagggggccaggtgtggtggctcatgcctgtaatcccagcattttgggaggcaaagttgggaggatcacttgagcccgggagtttgagatcagccagggtaacatagcaagacattgtctctacaaaaaataaagaagagaaaaattagccaggcgtggtgggaggattgcttgagcctgagaggtcaaggctggagtgagctatgattgcaccactgcattccaggctgggcaatagagcaagaccctatctcaaaaaaaaaagaatttttttctaactactactgaaagtgactgagtgcaaaagagtaggtttctccattgtattcaaaataatgagtaggtcccaaaatatagatagtagtagttgacatatttcctcaaaaagcagccaggaaactcacttcagtatttgtttgtatatcagcttacaaaagaagaagtgaacctatactccatgtatttctagcttaattaccaagtagattaatggttgcctaggggtagagggaaggtggaaatatagaatgactgctaataggcaaggagtctcttgtaggtgatgaaaatgtcataaaattagattgtggtgatggttgcacaacttagtgaatatactaaaaaccaatgaatgatagactttaaatggatgattatgtaagtgaattatatctcaattttttagaaacgaagtaaaagtggaaatgtttctatctttacagatttgcttattctgaacatttcatataaaaggaatcagaatcatataaactctggtcttttgtaattgccttcttttacttaacataacatttttaaggtttatccaggttgtagtgttattctattttattgttgaataatattttgttgtatggatataccacattttctttatccattcatcagttgatggacatttgaattgtttcccccttttggctattgtgaatagtgctgctatgaacattcatgtacaaatttttgtttgaatacctgtcttcaattctttcatgtatatacctatgagtgggatatctgggttatatagttactctatgtttcacttttcaaggaactgccaaactgtcttccaaagtggctgcaacattttacattcttactagcaatgctggaggattccaatttctccacatcattgtcaacatttgctattatctctcttttctattataaccaccctaatggatataaagtggtatctccttgtggttttttacttgcattttcctagtgattaatgatgttaagcatcttttcacgtgctcattggccatttgtacatcttttctagggaaacatctattcatatcttttgcccaatttttaattagttcagttgtctcttttattgtggtaaaatataaataacataaaatttatcattttaaccatttttaaacacatagttctgtggcattaagtacattcccattgttgtgaaaccattaccactgtcatctccaaaacgttatcatcttcccaaactgaaactctttaactattaaacactaactccccattcttcttcccagcccctggcaaccaccattctacattctgtctctaagaatttgactattctaagtacctcatataaatggaatcttacaatattttttatgaatggcttattttacttagcataatgtcttcaaggttcatccatgttgcagcatgaatcagaattttatttctctttaaggctgaatgggagagtgccatcaacaagatcgtgaaacaggatgctgttcatatttctccacagcaacaataattttgcagccatccacagacaaaattgtctttgtaggagccttggaattcaggtacaagtttgtgaaacccctgcagaacccaagacttaggaaggtcattttgacaagaggtacccacatccagataacatacttactaacctttgtttcaactccagacccggaaacagccccatctacctgtgggctcagctacagccccatctagctttggtcctgctaccaaaaccatctgccaagaggcccaggggaattatgcatactactgcctcaggagagaggcctactaacctcagtatcagatgtggaccttgaaataacactgtaacttatctccagcctttcttagtaattgtacaagatcaatcctgctcacataaggatccagagggagacacacttaggtccctggggcaggattaccaacctcactcccacagcaggtgcctaaatggctctgaatcccatcttcagcctcacccagctttggtctgagagcaatccttcccacacagggacacagagggaggcatgctttgctgtgctctgcaggcaagccagtttacctagttcccatagtagatcatgaaacagacctaaaaagtggcatcagcccccctcagctgtagcttgagagcagtcctgcccatgaagagacctgcagggagaaatgaccatcagtgaccttgcaggcggacctgatgttctcagtcccactgtggatcttgaaatggccccgttatttggctccagtgcctctcaactgtagtctgatagcaggactgcccacccagggacccaccaggagaaatgccaatctgtgaccccagaaaaaggctgaagacttcagtttcagcttgtaggccctaaaacagccctgcaacttggttctagcccttctcagctgcagactacagtagtactgcatgccaaggtacccactcagtgatccaacaagagctttcccagggactcaaagtaagtcacacccatccacatacctagtaacaggcctgccatctgtgggccctgaattgggtgctcatcctggcaccagtcctacaaaccaacatcctagagacagtccagtcacccagggaccagacaggatccacagctgctagagcccctgataatagacctgccaactgtggaccccaattgcagacccagcagcagccacattacccagttcaaaccccatttgactgtgattccagaggcattccatcaacccaagaacctaacagaagaaggccttaacttaccaaaatcagtctgcaaagactgaaagaggaatttccttcaaatacatggacatcaatgcaaagctacacaaataaggaagaatcaagcaaatgtgagccaccaaaggaaacaaataaagttccaattactgacggcaagaaatggagatctacaaattacctgacagaattcaaaatgatcttcttaaagaagctcagtgagattcaaggaaacatagatagacaactaaataaaattaatagcctaggcagcatggggagacctcatctctacaaaaataattaactggacatgttggagtgtgccttatagtaccagctacttgggatgctgaggcaggaggattacttgaacccaggaggtaggctgcagtaagccatgatcgcaccactgcactctagcctgggcaacagagtgagactccatctcaaaaaaataataaaaacaaataaataaaattaagaaaataattcatgatcaaagtgagaagtctaataaataggaatcatttaaaaagaactaaatggcgctaaagaatacaatgatagaactgaagacttcaatagagagcttcaacagcagactccatcatacagaagaattagcacacttgaagagagaaaaggaaaagaaagtttatttaaagaaatactgtctgaaaacttcaaatgttgagaagggatatagaccccccagatttatgaagctcaaaagacctcaaatgaaataactcaaagaagaatactccaaggtacattatattcaaattgtcaaaagtcaaagacaaagcatcaagagataagagattcatcacatataagggaaccctcataaggctaccatgagacttctcaacagaaaatcttgcaagccaggagggagtaggatggtatatacaaagtgctgaaagaaaaggaaactaccaactaggaatattatacctggcaaatctgtcttttggaaatgaaggagaaataaagacatttacaagcaaaagctgagggagttcatcaccactgggcctgtcttacaagaaatactaaaagaagttcttagaattgaaacaaaaggatgctaattaacaacatgaaaacacatgaaagtaaaaaactccatggtaaaggtaaatacatagtcaaattcagaatactttgataatgtaatagtggtatataaatcacctgtctctagtataaaagttatctctagtataaatgttaaaagacaagactgttaaaaataactatagctataacattttgttaaaggatacacaatataaagagatgaattatgacatcaaaaacataaaatgttggggtagacaaaagtgtagagtttttaaaataaccttctgtaaatataagatgttctgtctaagtcttatgatgaccacaaaacaaaacctatagtaaatacacaaaagataaacagaaaggaatcaaagcataccaccatagaaaatcatcatatcacaaaggaagacaaaaagaggaagaaagaaacaaaggacctacaaagcaaccagaaaacaagtaataaaatgacagtgataagtccttacctatcaataattaccttgaatgtatagggattaaagtctccaatcaaaagacagagtgaccgaatggatttaaaaaaaaaaaaaagacctagtgacattctgcccacaagagactcatttaaactttgaggagacatatattgaaagtgaatagatgaaaaaatatattgcatacaaatggaaaccaaaagagagcaggagtagctgtgcttatgtcagacaaaatggactttaagtcaaaagctgtaaaaagagacaaagcaggtaattatataatgaaaaaaggggtcaattcatcaagaggatataaaaattatgaatatataaggctgaataacattccactgaatgtatacatactacattttgtttatccactaaatctgttgatggacccctgggttgctttcacgttttggctattgtaaataatgttgctataaacatggcggtacaaatatctgttcaagttcttgctttccattttttgtggtatatacccagaagtgaagtggaattgttgtattgtggggtagttatatatatatatatatatatatatatatatatatattatgtttttccacagcagctgcaccatttttacatccccaccagcaatagacaagggtttcaatttctccacatttttaccaaaacttgttattttctggtttgttttttactttttatttatttatttacatatttattttttgagacagggtctcattctgtttcccagactgaagtgcagtggtgcaatcatggatcactgcagctttgacctcccgggctcaagcgatcttcccacttcgtcctccatagtagctgggactacaggcacacaccaccacacctggttaattttttaaattttcttgcagatacagggtcttaccatgtagcccaggctggtcttgaactccttggcttaagccatcctcctgccttggccccccaaagtgctgggattacaggtatgagccaccacgcctggccttctggtttgtttttttaacaatagtcttccaattggtgtgaagtggtgtctcattgtagatttgatttgcatttccttactgattagtgaggctgagtatctttccatgtgcttattggctctttgtatatcttctttggagaaacatctactcaaattctttagccaatttttaattgttttttgtcatttgattttttatttatatggattctttatatattatgggtataaatcccctaacaaatatatgactgtaaatattttctctcattctgtaggtttttgtttcactttcttatgctgttctttgaagcacacagattatacctttgatgatgtctactttatctatattttgttggtattgcttgtgcttttggtgtcatatctaaaaattcattttctaatccaaggtcatgagacttcatatctgttttcttctagcagttttatagtattagcttttctagttaggtctctatggtctactttgagctaattttgtgtatggcatgaggtagaggtctaacttctttcttttccacgtggatattcggttgtccaagtaccatatgtataaaaggctatgctttcctcattgacttgccttgacatcctccttctttttattaaattcaaagtgagtacatggtgaatgaactcccattcataattgccacaaaaagaataaaatacctaggaattcagctaacaagggaagtgaagggcctattcaaggaacactacaaaccactgctcaaagaattcagaggtgacacaaactaacggaaaaacattccatgctcatggataggaagaatcaatattatgaaaatggccatactgcccagagcaatttaaagattcaatgccattcacattaaattaccagtgatattcttcacagaattagaaaaaactattttaaaatttatatggaaccaaaaaaaaaaagagcccaaataaccaaggtaatcctaagcaaaaagaacaaagctagagacatcatgctacccaactttactatattactatactacccaactatactatagggctacagtaaccaaaagagcatggtactgatacaagaacagacacatagaccaatggaacagaatagagaactcagaaataagactgcacatctacaaccatctgatctttgagagacctgacaaaaacaagcaatggggaaaggattccctgtttagtaagtggtgctgggagaactggctagccatatgaagaaaattgaaactggaccccttccttacactatatataaacatcaactgaggatgaattaaagacttaaatgtaaaactttaactataaaacccctagaagaaaatctaggcaataccattcaatacaagcaaagatttcatgatgaaaatgccaaagcaattgcaacaaaagcaaaaaatgacacatgggacctaattaaactaaagagcttccgcacagcaaaagaaactatcagcggagtaaacagacagcctacagaatgggagaaaatatttgcaatctatgcatctgacaaatgcctaatatccagcatctgtaaggaacttaaacaaatttacaaaaaaaaaactccattaaaaagtgggcaaaggacatgaacagccacttctcaaaagaagacatatatgtggccaaaaacatatgaacaaaagctcaacatcactgatcattagaggaatacaaatcaaaaccatagtgagataccatctcatgccagtcagaatggctattattaaaacgtcaaaaataacagatgctggcaaggttgtggagaaaaacaaacacttttacactgttggtaggagtgtaaattagctcaaccattatggaaaacagtgtggcgattcctcaaagacctaaggacagaaataccattctgcccagcaatcccattactggggatgtacccaaaccactgtatatattcgttatatatgtgaagcaatataaatcgttctactataaagacacatgcatgcatatgtccattgtagcactattcacaatagcaaagacatggaatcaacctaaatgctcctcaaccatagactggataaagaaaatgtggtacatatacactatggaatactatgcagccataaaaaggaacgagatcatgtcctttgcagggacatggatggagctgggggccgttgtgcttagcaaactaatgcaggaacagaaaaccaagtaccacgtgttctcacttatcagtgggagctaaatgatgagaacacatggacacatggggggaagaatacacactggggcctgtcagagggtggggagtgggaggagagagaggatcagatagaataattagtgatgctgggcttcatacctgggtgatgggatgatctgtgcagcaaaccaccgtggcacacgtttacctatgtaacaaacctgtacatcctgcacatgtacccctgaacttataagttggaaataaaaaaaaaagtgagtgcatgaagttagaaaaggacgcaggagaaaatttttcatgtggtgatctttagaacctaagctttaagtttgttaaaccttcatgtttctcatgagtaaaatatggtaatgagcttagtacgatactgttgattacaaagtattgaggggtacatatcacattttcagaaagtatttaccttcacagtctggagttataaggtatttgtatgcttctttgacaaatacctgcaaatgtaaatatgcagaaggttaattgagtttttgaatgccatttctactgaacaggagagtttcaggtataaatgtctttgctatatgtaaactaatattacatgctctttcagcttctctttttcatacccaataaagcttttagtaaataaaaatgatgcagatagagaaaatgcttcttgaggtgtattttaataggaaaagtttctgacctgtcagtcagtttttaaaattccagagaagtgtctgccatggctttttttttagacacaaactaacaaaaatgtcacacttatgctgtgaccacagctactattgtccccacagagctagggaccaaaaaatcttccagttctaataacatatttgaatgctaggataaaccaattgaaaaatagattagagccacgaagaacattagagatcatgtaatatttagctcacaaatttagtttgtttgacagtgttttaacaattaaaattagtttcccctattttttaaaggaaataatttcaaataaaaggttgaacttttcttgaaaaccagatgctctggcaatcctgggcctgcattctcacatggtaacaatgggctggaactgagaagtgttcttcaggtcatcactcactcttgtccctctgacactaaaatgcttgtttcatttccatgaatcattacacttacagttatgtttcacgtagcagcccatttcatttattaatgttacctgcctggaccctcacatctgattcaattctcaccccactccccctccatattagctttctaatgctgctgtaacaaattactacaaatttagtggcttaaaacaacaaaaatttgtaatctcacactcctggaggctagaagtccaaaatcaaggttttgggaggtttggttccctttgtgggttctgaaggagaatctgttcatgcctctctggtggctgctggcaaaccttgctattctttggcttgtggacccatcactccaacctctgccttaatcttcatatcactttctcatctgtatctgtgtgtctcaaatcctcttctgcctatttcttataaggacacctgtctttggatttggggcccaccctaaatccaggatgatctaacattgagatcattaactaattttatctgtaaaggccctttttccaaacaaggccgcattcacaggttccaagttaggacatgaacttatctttttgagaccactatttaactcactacaactccattttaaagataagaaaactgaatccaagacaggtttagttactcctccaaaatcatacaactagtttgtgatagaattgattcaaaaacattagtcccctaactcccaaatgagtttcctttccactattttatgttgctcttttacttcagatcagttcatgttccacataaaatatggaataaacataaagaataataagtttcctctagctctatcactttgtaattttgtgcattattttagctgatggaaatctttaaaatgtgtgatctctttaacagtttgttattctctattaaaatatcagaaattagtacataaaccagttgcatgttaatttaaagctgtctgaagaaaagattttgttgttgttcaaattctggctctgttactaaattgctgtgttttcctgggcaagtcccatcctctctctggatttcaatttgcccacttgtaaaacaaaggagttggaccaagatgaattctaaggtctcccccagcaccaactttctgggattctgtttttgcagaattattctgaatgtggttaatcagccactttgaggtactattgtccagctaagcttttaggaatagtagtttccagaagagaaaatctatttcaccaccacctctattttgagttgatttttgtatatggtataagaaaggggtccagtttcaatctactgcatatggctaggcagttatcccagcaccatttattgaatagggagtctttcccccattgcttttgtcgactttgttgaagatcagatggttgtaggggacggctttatttctgggctatttctgttccgttggactgtgcatctatttttttaccagtaccagtaccaatatttttggttactggagacttgcagtatagtttgaagtcaggtaaggtgatgcctctagctttgttctttttgcttaggattgtgttggctattcgagctcctttttggttccaaacgaatatttaaattattttttctaattctgtgaagaatatcattggtagtttgataggaatagcatcaaatctgcaaattactttgagcagtacggccattttaacaatattgattcttcctatccatgagcatggaatgtttttccatttgtttatgtcatctctgatttctttgagcagtgttttgtaattctcattgtagagatctttcacctccttggttagctgtattcctaggtaatttatcttttttgtggctattgtgagtgggattgcattcttgattttgttctcagcttggatgctgttgatatataggaatgctaccgatttttgtaccttgatgttgtatcctgaaactttgccaaagttgtttatcagcttaaggagcttttaggcagagactatggggttttctaggtataaaatcatattgtctgcaaacagagatagtttgacttcctctcttcctatttggatgtcttttatttctttctcttgcctgattgttttggccaggacttccagtgctatgttgaataggagtggagagagagagggcatccttgtcttgttctggttttcaaggtggggtgcttccagcttttgcccaatcagtatgatgtggctatgggtttgtcatacatgactttttattattttgaagtatgttccttcaatgccacatttgcggggtgggattaacatgaaggctgttgaattttatcaaaggccttttctgcatctattgagatgatcatgtgtttttgcttttagttctgtttatgtgatgaatcgcatttattgatttgcatatgttgaatcaaacttgcatcgaaggaataaagcctacttgatcacaccacctctattacgatgaggggatgagggtactttaagtttagtttccagcggtgagactggatttgtacgatgccatccatcttcctcctcaccccatcccttctttgcagcctttctcaacctacacacacacacacacacacacacacacacacacactgatgcacatacccttatcatctttctgtcccagtatatagccattgaaaaagaagtcaactggcagaccaagatgtcaaaccctgattttaaacactttaacaccatcctgaaaccaaaaaatacccgttttgactataaacaggtaaaagagtaaaaataaaaaatcctacattatataaatgttgttctgacaaactgttttcaccctgatttctcttcattgtgctctaatttttaaaccttcttgacatttgactttataggctacaactttccactttccacatttgactttataggctacaactttccactttccactttccacagcggtaattatcatttgttctgtggctagttctgaaaaaggagccaggaaatttgagcttccagcaaaatctccctgagtataattcactagataaactgtacaagtctattctcttttaaataaattacttgagttcttacttaaatgatgtactgtattagtttgccagggctaccttaagaaaataccacaaactgtgtggcttaaacaacagagatttattttcttgcagctctaaaagctggaagtctgagatcagacttccagtcaggtatcagcaggattgatttcttctgaggtctctctccttggcttgcagatggccactgtcttgctgcctctttacatggtctttccactgcctctttacatggtctttccactgcctctttacatggtctttcctctgtgagcacgcatttctgatatctctctgtagattctaatctctcttctgataaggacaccactcagattggatttaggcccactcagcctcatgttaacttaattacctctttaaatatcttatctccaaatatagccacattgtgaggtactggggggactggtgtgacatcttggtctgccagttggcttctttttcaatggctgtatactgggatagaaagatgataagggtatgtgcatcagtgtgtgtgtgtgtgtgtgtgtgtgtgtgtgtaggttgagaaaggctgcaaagaagggatggggtgaggaggaagatggatggtttcgtacaacatacaaatttggggagaagaggacacaattcagcccataacatgtaccatattatttcacacattatgaaatgttaaacctagaagtaatttagagactatttagtataatcctctcattttgtaggttataaagactgaggtacagggaagttaaaaacacttacctaaggcaagccatatggaattagtggcagaggcaggactagaaatcaggtcttccagctccaagttccatgccctttccaccataccatgctgctactttagtccatttgacttattcatgcctttaacttctcttcttctcactcttcctcttgatgatttagaataaatttggcaaatatattaaattagctatttttaaaactatatttaccttaattttcctgtacttactaccctccacaactcaaattttgaaaataaaaatatttaaggagttttctacttaatttcctatcacttttctctttatacatatatttttcactcttgctttgaaataacaggatttttctaaggtaaatgaacttttgcttgccagaatagacaatgaattgaaatcaaagaaccctcagctttttgtcacctttttgggatctgaggtagagaaaaaaatttgcacaaacctatgcctctcccctttcttattacctgtccttctctttccctacagtaggattttaaagcttctagaaactttgatatacacactcctcctccctcccccaccaaaacaataaataccatcattgaactggtgccataaaaagtgcctgatttttcattctttagccagaggtatttaagctcaaactttggaacctgaaaggaaagaaaattctgaatataaatgtacctttcctttacttgtaaatcttctccattcgccttttagagtgaaatatcaagagagaaaagggagaaactttgagttataaagtgagtgatatgaatgtttaagacatttattaaaattaggtgtactcttccatttaatccagggttttacttttacttaaactactaaagaaactatttcttttcaatagtcagctagttacttcagtggaccagggaacacttttttctctcctgtctaaagctccagttgtttgcttcttgagagatagatgtttaatgacaaaaagcctttcttcaaatgagtcccttgggtaacatagcccccatgctgcccctctcttaccttgctgattactaaggaattcatctggataagtcaccctctatggagacaagaaaggggcagggattcatcccatcctgcctctagtgcaacgtgtcagagcttgatcctattgcctgcttattcagtacagacagaaacactgggaagcactaaaatatagatgtctgtgccattaaggtacaaaagactattaaaatatgtctgtcaagcagatctgtattgtatcacagtcttaatgattttgactgtccagaagatagaaatatagattaaatttgattgacatgctctcagactggacatgaatgtgtgggtgaaagtaagtacaggatcatattatttaataaacaatttggacaacatgaaataataaaaacagtgatttctttttcaaatggcattctcagagggtctagaaatttctgatttggtggaggggggttggctataggactcgattcctccccctacccaagtaatttcgactggaagttccatatgtatttttattgtggtaaaaatgcataaagttccactttttatgctttaagattttaatttctgttttctagttcatttgaggttgggcatggtggctcacgcctgtaatcccaacactttgggaggccgaagcaggtggctcatttgaggtcaggagtttgagaccagccctggctaacatggtgaaaccccatccctgctaaaaatacaaaaaaaaaaaaattagctgggtgtggtggcaggcacatgttgtcccagctactcaggaggctgagacacgagaatcgcttgaaacccgggaggcggaggttgcagtgagccgagatcacaccactgcactccagcctgggtgacagagcgagactccgtctaaatagaaaaatcaataattcatttgaatagaaagttcattggtttctaaaaaatgtcctaaagtactatgagagaaaattttttcctgatatctgaatatgtttatataaaaaatcttggctatataaaataaaaataagtgttatgtattgaaattttttattgaaaaccatacaattggaactgccctggttgttgtaccttttgaacaaatttccttcacatagtgacaaattgcttttgtcatcttttccctatccttgttttcagcagtcagaatagcaaggtccactatgttgtctgatgtgcctacagccaggctctgatggagacagagttctcttgcttttttacttctttgcaattaccatggctttcagcagacatttgcacccctgtaacttggtgggtgctgcttttgctatgatttttaagtgtcatcttctatgaagtatagtactgaagaggagttattgtatagtgggaataaaactgttgagctccactggatggttcttttaatgtgagatcataccatccagtaagactcagagggatatattgaaatcacacatttgagaatcacttccattcttctccagcactattgcttatcataaggattgaactagttccgtgagagacacaatgaggtacatctggtgggctagatttgctgtaatagcctcatcaaatggtccatgttaatcacagcaactagcaattgctttaccattgttcaggttgtcatttgcaatctgattatttggtaatgaactgcccttagccgacctgccaacctcaggtctgtttacgaaacctgtgacattatgagaaatacagtattcctagtagtataatccaaaaatctagaaaaccatgttgcaaatgggagggaggtcataattcctgtctgagtattggaagttgcaattattaacagttgtgtgtgtgtgtgtgtgtttgtgtgcgtgtgtcactagataatatgtatatacatatactgtaattattacaatatatatacagtgaatacatatatgtaatttcttaactgttcctacccactctattcattaattccatacaattatatatcactttacattctccaaaatacttccgtatacattcttgtttaatccttatactagctctgttagtaaaaattgttctctattttataaagaaagtgaagctatgaaaggtaatatatcttgcaagatttcagagctaggaaatggttgagtccgaattgtttttctaaactcctagcctactgcttttttctgttacaccccagctatctttgttatagaggcagtgtgttataatggacccagactgcccggatttgaatcagagatcttttacttcctagtggtatgaccttagacaaattattaaacctctctgtgccaaagtttcctcatctgaaaaatggggttaataatagtatctacctttgttgtgaggattaaacgagttgatatagagatggtgtttggaacagtgacttgagtagttagcattatgttagtgtttgatgctattattacctttattattatcattcttgtcataatcagcatattgcatagcatggtggctaagatctctattttttaagatctcagtcactgcatgcaaacagtctagattcaaatccaaactctactactgtgtgaccttggacaaattactttgactttctgtgcctcagttttatcataaatatatatatcatatgtatgatatatatatatcaaacattgggctaagtatgttatatgaattaatttagtagtcataacagccatgtgtgactaacactttatatatttatgatatatatattttaatacatattttatcataaaaatatatatcataaatatataaagtgttagtcacacatggctgttatgactaccaaattagttaattcatgtaacacacttagcccagtgtttgatgttagaacccccacttgccttattcctaacatcttggctgcaaactcagacccatgaggtgtctgtatggcagttgtatattgtatatgacatatgtaattcatcagtcctctatagtctaatcacacaagctagtggtttggttgtcatgatagttcttggtaggaatgtgtttgtcatataaaagttattttggtatggtgtggtgaaatgagtattcactggagatctggttctattgccgagtggccttacaagtgaaattctggagcctggagaaaaaaactttagcaagagtaagaaatgaattctcagtcaccctcttttctctctccctactaatgctgtaatgctatattttccagcctatggtggggtgggtctatagtggtaagacagtgtggtatcattatatttaggaagaaaattgtttcaagtttgaaattttttccaatattatattagaagtcaactggagaatgatatttacttagtagttattttagaaataacttttctaggcccaatctattaagaaatgaaggagatcatcctacagacagatcacaggcaaaccctcattttagggaatgactttattccagaagataatttctaagttgatagtttggcacttgaatatttttctatagaaattatgttatttttctgtagcaattaggttattgtgttattatgctgaagtttccaggttagcctacaacctgtgaaaggattgaaatactgtgatagaactgaaataccgtactgtactgaaatactgttaactagcaattaaagcaaaatgtaattgaataagaaatagcaccttgacactaaagcatgagcatagcagagttaattacaggttaagaagatagatggaggctttgggagagtctttctgaagagcacttctaggtactttcaatggacattagaagttgatggcacaggttttatgtctaacttcagaaaggatgacttttcttttccttgatacagctatctcacagtgctcttataactatcagccattattagggctatttggggttcataaatagaacaaagagaccaagaaaggtaattttgaggtaactgggcaagaaatagcagaagaaagaacatttaaaggggtaatatggatccatgtgaggttatgtgattgcttaaggtggaattgaccacagtaaatgataaaaagaagaaaagtggggagctcagtttgtgcgtaggatcccagtggaaagaaagacagtgagaagctttccaggaaaccccagcacctttttaacttcaattcacacattctttctgtactgttccttttgtgttccctttctcccctactagactagttcttgaagggcagatatggtttcttattcatccctctgcttccaacaataactagcacatagtaggtgttaacacactgtatgttgaaatgatatcacatatgatcttttaggccaattaatgtgcttcttatttgaccagggcattagaaagctgtaaaattgtgctctcaactagcatttggtacatagttctagcatttgagttgaattcagaattgtaatgttataaatagagaactgagaacccatgcatgaattgtccgtttggtatagacctagtctcttttccccatttcatgagtgacatcatcttttctttctccatctctctgtcttggagcatggtctggccaaactaattttgtaaataccctaaagatggagctttggacactccctgattgacaaagctctctggagcttttataccttctctcagaaacacatagtaacattctggttccaaagagatggtgtagagtttgactattgattctttgtcctgcttgcttgcttttgttctgtttgaccccttccctgatgcattcctgctggagacaaacccacatgctgaaccatggggaacagtctgtaatgaaacaacaagctgctcccaattttaaatattgcatgttggggcaaaggcagagttccttttcctctaaagctataacattaaaaaaattctgtttgatattcagagttatttgatctggcagtttaacaactgttgatgttttaattgcttctttaaaggatttcatctacatttctaggtttatttttattttactctgaaggaatgtcaatattagccatcattttgcccagtaagttcccattgcaggatcttggagtaaaatccagtaattactggagctggtaacttaagaccctgctgagaaatttggcagcttcacttttcctgaggaggcatctctccccatggagctagcaatcatttattgttctgaatcaattttaagtgagttttgtaccttagagaccagctttctatgttcctttgaaagctatttaaatcattctttttgggtgaaagaggaatgttaagtcatgttaagtcactctttttttgtatgcacctaataagagcaacaaagtaactcttagacaaatgtacaattgtaagatgtgctagcaagaaaaatttagcaagtttataatccctcagggtcttacttcatttttatttgtctattcataagtttatttccaagaccaaatagaatgttttgttggcgtgctacttacatgtatgcagctagccatttgaattctctcaacaaaactacacacattcaaagcagtttagagatgaaagggtcctctgagatcatctagtctagcctcttctaaatgctttaaccttgtatttattaataaaaggagagctggatgagcttgcatctttgctcttctgtcatatatcctttgaattattccaatgaaaaaaatgtttgttaaatgcttagatgctgaacccagtctgaagcaatttgcttcagaaggcatggttcttagagttttggagcctacacagtaaaaccaatagcactgacatattatatattgtctgtcacattttctcttctgaagtttctttacactccatcatcacccctaccaggccccctccgcacacacacacacataaacacacacacacacacacacacatatcttggggagatgaaaacaaatctcttaaacttttatttttctgctttgaagccacactcccagaaaagacttttttttaaaaaaagtattttaaaaattattaaatttttaaaaattttttttgaaaatttaaattaaaaaactatattatgggtacataatagttgtacatatgtatggggtacatgtgatattttggtttttgttttgttttgagacggactgttgcccaggctggagtgcagtggcgtgatctcaggtcactgcaacctttgcctcccgggttaaagtgattctcctgcctcagtctcccgagtagctgggattacaggcgcccaccaccatgcctggctaatttttttgtattttttttaaagacggggtttcccatgttgggcaggctggtgtcgaactcctgacctcaagtgatccgcccctctaggcctccaaaagtgtgagattacaggcgtgaaccaccacccccagccacatgtggtattttgatacaggcacacaatgtgtaatgatcaaatcagggtaattggaatatcagtcatctcaagcatttatcttttttgtgttaggaatattccaaatcaattcttctagttattttgaaatatacaagaattattgttaactataattgacctattgtactaccaaacactagatattattccttttattcaactgtatttttgtacccattaaccattccctcttcccctcttttttttttctttgagacactatcttgctctgttgtctagactagagtgcagtggcacattcatggctcactgcagccttgaactcttgggctcaagcaatcctcctacctcagcctcccaagtagctgggattacaggcatgcaccataatgcctggccatttctttaaatctctgtagagatagggtctcactatttgcccaggctggtctcaaactcctggacttaagtgatcttcccacttcggccttccgaagtgttgggattacaggcatgagccatcgtgcctggccccctcttctactctttatccaccctccccactagccttcccagcctctggtaaccagatcattttactctatcaccatgagttcaatttttttttgtagcttccacatgtgagtgagaatgtgcaatgtttgtctttctgtgcctgacttatttcatttaacatggtgatctccagttccatccatgttgttgcaaatgacaggatctcattcttttttatagctgaataggactcctttttgttataagtaccacatcttctttatccatttgtctgttgatgaacagttaggttgcttccaaatcttggctattgtgaatagtgctgcaataaacatgggagagcagatatttcttcaatatactgatttcatttcttttacacatatacccaacagtgagattgctggatcatatggtagttctatttttagttttttgaagaacctctatactgttcttcatagtggctgtactaacttacattcccacagcagtgtacaagaattgccctttctcttttacccttgtcagggataatcaaaggttaaatgaaaggaccagccaactgattgatgggagggacactggttaggatagttgaggagaagtggacttagccacaaggtgtattattcagctttcccatatttttccttcctttactctatctcctcaacactgggaatataagacttttcactcatagacttaatgtccaacaaactttttgggaaatggaagcaattactagttcagctgtctggttcttcctctgaatttttttttttaatgccgaaaacccagaaacttccaaatgaatctcctggccttttctactggttatttcttgtgcagcttcactaggcttaaaaggtcagcctcttcattgggccatgatgttatgattgtaactctagactattttcttcttggcatcccttctcaatagatagcactcagtgattgaaagtgtaacagattgctactgtgtgaggaatttcagaatataaactatggtagttagaaaatgatatggatatagtatatgttagaacccgtctttgcctggatcacttttcatgagtctttttctgttgatgttgacccgttctagcccctccgaacctaaggtttttgtttttgttttcacttgacttaactagaccataagctccatgagggaggagactatcctgtttgccttattcactgctataaatttccatatctcatatgcctaatataatacttggcacatagtaggcatccaataaatatttactgactgaattaaatagtcagtagtcttgtcctagttcccgtatttgctacagtaagagccctcttgctgaactctgcctggttattgatgaaaccaggtcatctatgtcttctgtttatctttgagtatagactataccccagcaacttccaacaaccttctggcagcaatatttttctgattgcccactcttaaaactcttcaagtgccctcttctcacaccagatttctgtcctaactaaccatcctacgtcatttctgacaaaatctttcctttatctattgttcaagattatatgagttcaaaaatttcttacgatgtactgtacttgcagtcagtctcctacttgatgtcctatagaacacaaagttacatttgcataataagggccacctcctttctatctcccagaagggctaccccaaatcataaatagtaagaggaatcttttgagcacaaggacaaaaagaagcaggataactccattttttgaaaagaaaattttaaaatatcacattgagatgatggtgtgaaagtactttcctgaagttaaatttgcaagtgtctgccttcttctctcctctgggtatcacactgacacatctgccattcgaattggattttgtgaagcttttgaattgtgagtgacacagaatgctgtggctttcagaatgtctttgtattgttccctcctgagagctaggatgatgggatatattatggtggtgctgtctgtattctcaatcatcagcgcaaattgacagcagcaccataaagtcaggtttattggcacgcgtgcacgcacacacacatacacgcacgcacacacacacacacccctacaggttgttagagtacaagttctacagtatttatgtaaaagaaaaaagaatacttttagctaaacgtaatgtcttttcttctctgtatttccatgcatacctgagaacataaaagatattcaataagtatgtggaaaagttaaaattgttgccttgatgacagtttcatttctcaggctgtagaataattcaagcaaggaattgctactctggtcataattctgaaaaggaagaaagaactgcttggtgagatagtgatgataggcaccttgggagaaagtgagtgtgtcatactagagtttgtaataatgaaggaagtaagtgctgctgatggttccacatctattataggctttacaaaagcatatttcagaaattagggaaatgaaagataggtatgtcccccttgtcttgatatactacatttttttaaatgataagaggctttcaaagttgaatactcctaatttcttggcaatagagaaggaaagggagtatctaaaacagtcatattcaacatttcctgtgccctaacacacaccagaaaggacatgacatatgcctagtaatagtgctcactacagaaggtacaataacacacatcacaatttatagagaagcatatgtattttgaatccccacccaaagggccattctcctctccctagcctctacacatggtgtcattgttttgtgtgactgcacaggaagttatttgataagttcagatgtgacatgttaaaaggaagaacatagaaccaagtacacattctagacaaggacattattctataaatagtatcaggaaagtcagagccttgtaaaaaaaaatgttaaggaccactaaatgtgtacatatatttagttctgtttagagcaagaacaaggaagagctaggcctacttggcatcctgttaaaagtgacagctggcagaactattcaaccagacttctgtattaatgatattgatgttcaaacagaaaagggtgaatggaacatggttaagaaggaatttttgaagctcaagttagatgagaaattagaaaagagatatctattccctttgagtctctaatcccagaagaactagatctaagagaaaagaaaaaaaaatctagagaagaaaaactagatctatgagaaagaagctgcagagatagtcacaaaactactactcccagtttttgagatgtcataaagggtaaattccaaaagataaaagatggacaaattccctgattttctcagagaggaaggttgggagtgatttgctgaagctatggatctgtacacttgacaattactcccagcataattctaaaatgtattttcaatgagatgctttatagacattcattaaagaaaataatggccactgggacctccaagttggttctctaagaagtcattaagaaaataatatttatgtgtcatttcttgataggatcactaaactagactttaagggcaagacatcataaaatagggatccagtaagataattaatcctatatcttgtgttatccttgtagagaccaggacataagagaagactgatagcagttggaggaatttaccttggttgaactctgtgtattcatttcaatgtagagggaattactgagtagcttaccatagagctctgtcctgttcaacactttcatcaataacttggacaaagatataaaaagtatatatatatatatataattattggattatacaaaattagaaacaacagataacatatgcatgacaaatggcttgtctggtatcaaccaaggcaaggtaccatacttcaggaatcactggaaaatattgcatctggaggaaggttttacttaggggctgaaaaccatatctgatgaagaatggggattttttagctttgcaaataaaagactttagtgggacatggtagtggtctttaaatattagaaaaaatggtatatgtaggagaaattagaatgatgagggaatagttggaactgagtggaggatatataggaaggaagattttggcttagtttaggacaattttctaacatttttttctgtttaacatagtagtggtctgtttaataagttagtgagctccttccctatcaatagaggaattcaagcagaagctagacaaccatcttttggagtgattgttaatgtgattctttccttagaggaagatttagacaagatgagttctgaaatctcttccaactctgagattttatgattactatctctactggcagtttttcttgttaacaactgtgtccatcataattttcaaagggaaagtcagtaatcctgaaaattacatcacagatatcctgtttataaaacttttccccccaaatgtttattttccatcttctcatatcttccttcctttctttccttcccattacccatttaaaggcatattcaattagtaatacacctgtagtgataatcagagccctacttatttataccttctacaattatttgggtttttttgtttgttggttggtttgttttgttttgttttgtttgagacagtgtctcactctgttgcccaggctagagtgtaggagcttgatctcatctcagctcacagcaacctctgcttccaggttcaagggattctcgtgtctcagcctcccaagtagctgggattacaggtgtgtaccaccacgcccagcatttttgtgtttttagtagagacagggtttcaccatgttagacaggctggtgtggaactcctgagctcaagtgatccgttcaccttggcctcccaaagtgttgggattacaggcgtgagccaccgcgcccggcccttctacaattatttgtaccatcagaatgagctataaatttgcttgctcttttcttttgtatgtatgtgtttggagaaaaaaactttacaacatttttaacagaataagtcaatatttattttgaaaaagtgatatactgcttagtctccaccatccacccagtaaaacaatctgtcttctagaagtatcaagtactgttttatcatttaggatgtcacctgaaaagattaaggatagtccaagcattctagtatcccctattaaatgactatggatttatctcttgtctataaatgtatacaatttttcttgaaccttttttacccatttctattttcagcctaaatcatttctaagtataatgatgataatgaactcataaatttttgataaagtagtatgcattttcttccacacaagtgtttggcattgttgcatatctcttttaagtggataattcaacagttattaagcccctactatgtgttaggcagttttatatctattattaaagtgcttatgaagtagatggaattactcatagatttgggtttttttaattaattatttttttttttagaaacaaggtcttgctacgttgcccaggctggcctcaaactcctggattcaagtaatccttctgcctcagcctcctgagtatctggggctataggcacactccattgcacccacctactaataggttttaactttggttttcagtgggttatctataatatgctaggtaaaggagagagagagagagagagagagtgtgtgtgtgtgtgtgtgtgtgtgtgtgtgtgtgtgtgtgtgtgtgtgtttcagtcttcctaggggtttactgtacttcttgaatctttaatctatacatttatatctttgaccaaatttggggaaattttgaccatttcttcaaatatttttctaccccattttctctctcctctccttctaagatttcaattacatatgtgtttgaaccttagctttcatcttacaggtccctgaggctctgcttattttttccaatctttttccttcctattgtctaagttggacttttctgtgaatctatcacgttcactgactattttgtcatttccattctgctaagtctgagggtgaacttttatctcaaatattggatttttctgtttcaattttttctttctttttcagttactatttctttgttgagattttctgtcttttactttatgcagatatgttttcctttatacgctgaagcataattaacaatagctgccttaaaatcttgtctgctgatttcaatgtatgtatcacttcagagttggtctctgttagaatgagtaacattttctagtttttttcatatgttgaatgtgaaaaaacatattgtatactggatactatgaaagattgtatactacatactttgtattatatactgggtactataaaagattgtgttatagaccctctggattctgttacattcctcaaaagagtatttttttaagcaagcatttaacttggctgaactcaaattataaaccctctctcccctgcagtgggaagtagctcaaatctatgttcagaacttttatgtttagctgggctgcttgtagtctgccctgcacatgtacagttcaagtgttagccagcgattcagacagaatctatatccagaatttaggatcacctctggctttctgctttctaggatttctccctcactttccaatagctgtagatgcccactctgtcctccagttctttaaaccagtgggaatgcagatttctatctgagttctacacactccatgagatgctaaaagccatttttagaaacagaaaactcactcaatttcccttattttaaatgtcaactcccctctcatgtgttccatctgtatgcttgttttattctccagtgctttcaggtagctttttactttttcttttatccagagttacaggcacacctcagagatatattgtgggtttgtttccaagcaaccagaataaaactaatatcataataaaatgagtcatatgaatttgggggttgcccagtaagtataaaagttatgtttacatgatactatagtctgttaagtgtgcaatagcaatatgtccaaaaaaacaaactacataccttaactcaaaaatagtttgttgctaaaaaatgctaccaatcagctgagccttcagtcataatctttttgctggtgaagagtcgtgccttgatgttgatggcagctgactgctcggggcagtggttgctgaaggttgaggtggctgtggcactttcttaaaataagacaacaataaagttcgctgcatcaattgactattgttttcacaaaagatttcactgtaacgtgatgctgtttgatagcattttaactatagtagaacttctttcaaaattgtgttaaatcctctcattgtcattccaacagtgttcacagcatcttcaccaggattagatcctatctcaagaaacaacttcctttgctaatccataagaagcaacttcttatgtgttcaagttttatcatgagattgcagcaattcagtcacatctttgggcttcagttataattctagatctcttgctgtttccaccacatttgcagttacttcctccactgaagtcttgaacccctcaaagtcatcaatgagggttagacgcaacttcttctaaccttgtattaatgttgatattttgacctgcttccatgagtcatgaatatgcttaatggatctagaatggtgaatcctttctggaaggttctttacttactctgccccaatacatcagaggaattaccatctatggcagctgtggccttatgaaatgtatttcttgaataataagacatgaaggttgaaattactccttgatccacaggctgcagaatgggtgttgtgttagtagacatgaaaacatttatctcctagtacatctccatcagagctcttgggtgaccaggcatattgtccatgagcagtagtattttgaatggaatcttttatttttctgagcagtaggtctcaatactggacttaaaatttcaataaaccatgctgcaagcagatatgctgtcattcaggcttttttgttccatttctagagctgagcaggatggatttaacataattctttttcttttcttttttttttttttttgagacagggtctcactctgttgcccaggctggagtatagtggcattatcttgactcacgcaacttctgcctcccaggttcaagcaattctcccacctcagcctcctgagtagctgggactacagtcacacaccatcacactcgtctaatttttgtatttttagtagggacagggtttcaccatgttggccaggctggttttcaactcctgatctcaggtgatctaactgcctcagcctcccaaagtgctgggattacaggcatgagccaccacacccggtgaagatttagcataattcttaagggcctgtgatttttggaaaggtaaattagaattggcttcaacttaaaatcaccagctgctttaacccctaataacaagagtcagccaatcctttgaaactttgaaatcaggcattgacttctcctctctagctatgaaagtcctagatagcatcttcttccaatacaggattattttgtctgcattgaaaatctgatgtttaatgtagcaaccttcatcaattgtcttggctagatttttctggataacctgctgcagcatctatgtcagcacctactgcttcatgttgcacttttgttactggagacagattctttccttaagccgcaagaaccaacctttgctaccttccaacttttcttctgcagcttcctcacttctttcagccttcacagagttgaagagagttagggccttgctctggattaggctttggcttaaagaaatgttgtagctggtttgatcttctatccaggccactaaaactttctccatatcggcaataaggctgtttttctttcttatcatttgtgtgttcattggagtagtgctttaaatttccttcaaacacttttcctttgcattcataacttggctaactccttggtacaagaggcctagctttaagcctatctcggctttcaacatgcctttctcactaaacttaacgatttctagcttttgatttaacatgagagttgtgccactctccctttcactgacacttagaagtgattgtaggtttattaattggcctattttcaatgttgttgtgtctctgggaataggaaggcctgaggagaggcaaagagatgggggaacagctggttgttgggtaagtcagaatacacacaatattttttaattaagttttctctcttatatgggtgcagtttgtagtgacccaaaacaattaccctagtaacatcaaagatcactgatcacagctcattataacagatatcataattatgaaaacttttgaaatattgtgagaaataccaaaatgtgacacagagacccaaagtgagcacatgctgttagaaaaccaacaccaatagatttgctcaaggtaggtttgccacaaacatctaatttgtttaaaacgcagtatgtgtgaagcatattaaagctactgtcagatcaagcctcttgcagataataactgtattgatctgacaggagcttacatggccatgattagaagtggagccatcctgtaatatatctactcaacatgttttagaagagaatactgaggcccagaaagattaagcgaccttcccagtgtcacatgactagaaaataatagagctaaagtttaaatataggctttctggctcctgatccagagcatttccacatgttactttttataatttaccttttaattttatttttaattgacatgttataattatacatatttttggggtccatagtgatgtttcaatacatataatgtatagtgatcagatcagggtaattagcatatctgtcctctcaaacatttatcatttctttgtgttgggaaattcagcatcccccttctagctatttggaactatataataaattattattaactatagacatcttaacggtggtatagaagactagaacttactcctcccagctataattttatatcctttagatatcagtaatattctttctcaggcattattctcccagatgggtaagtcctgattcttttgtctctcctcatataataccaattactcccattaccttaatgagttttccttgtagatgtccactaaacattttccaacttccttctaatcttttttaggtttccactgttttccagtattggctttcattacataaaaagaggaaagtgtctcttgatttctttccaatgacctttttgaattatatcccagcaacatcttcagggaatggtttttgaggctttaaatatgatttctttgttaaaagtagaagcttagaaactgtaatcttacataattcagattattctcctcctaaatatgttactttattcacccttataggaaattttaccttttctatcctctcataagtctcattaggcctttctttttgtaatgtttcccatttgttgtagcctttcatatagaaagaactttatgtcctctgtaatcttaaacccatgttcttccagatcactagcaaaaatgttaagatagactgtgtggtattgtgaattaaaaaagcatcatggaccaggcgcggtggctcatgcctgtaatcccagcactttgggaggccaaggtgggtggatcacctgaggtcgggagttcaagaccagcctgaccaacatggcgaaaccccatctctactaaaaatacaaaattagccgggtgtggtggcacatccctgtaatcccagctactcgggaggctgaggcaggagactcacttgaacccaggaggcggaggttgcagtgagccaagatcgtgccattgcaatccagcctgggcaacaagagcgaaaaaaaaaaaagcatcatgacaggtgtacatatatgcaaaaactatttattgagtgcctactctgcactggtcactttgctgggtgctgaaggtataataatgagcaagacagacatagtccttgccttcctagggcttttatggtccagtagagaagtcagacaactaaacaagcaataaaaaataaaaactaagtgtggacatgggaggaagtgcagggtgctatggaagcacgtaacagtagaatctaacctgtctggggcgggagagggcagagaaaaccctccagattaagacagattctgatcccagttctgctgcaaccttatgtggctttcttgtcggtgctcctctcttggcctcagttttctctgagtaaataaagttgttgaacaagatagtcttcaacatcttttccaattagttaattctgcagtttcagtagtgatgcatgataccgttaagtgcagactttgaaggcagatacacctgagttttatactctctcgaccccaacttccacatctacaaaatgggaataatgactacttcagggtactggtatgagaattaaatgagatcagttatgcaaggctgaagttacagagaggacacagattaaacatgagccattttccttttatgccaatttcaataaataagcaacttaaagcattatctttgaagtaaaacatttattataaagtagaatgcaacgtttatatgaattttaagataaaccaaagaaattttctattttggtacatgccaccagacattagtaacattaatctctactgttctttttttttttttttttttttttgagacggagtctcactctgtcacccaggctggagtgcagtggcgcgatcttggctcactgcaagctctgcctcccgggttcacgccattctcctgcctcagcctcccaagtagctgggactacaggcacccaccaccacgcccggctaatttttttgtatgtttttagtagagacagggtttcactgtgttagccaggatggtctcaatctcctgatcttgtgatccacccgcctcggcctcccaaagtgctgggattacaggcgtgagccaccacacccggcctaatctcttttctcatgggtactttattgaaaaatttgagaagcactgtgtgaaagtacctagtatggtgcctggtataataatactctttattgagttcataataggaactcaataaatgatagatctggggagtgctcatcattacattttttaatatctagatcagtctcctttgtttattgtccttaaaattgttctcctggtcctacaacttctgtgttaactcatttttttgttgttgttgttgagatagagtcttgctctgtcacccaggctggagtataatggcacgtctcagctcactgcaacctccacctcccgggttcaagcaataatccctgcctcagcctcccgagtagctgggattacaggtgcctgccaccacacctggctaatttttgtatttttagtagagacggggttttgccatgttggccaggctggtctcaaactcctgacctcaggtgatccacccacctaggcctcccaaagtgctgggattacaggcatgagccaccatgcctggccgctcatttttgtttgtaagcaatctgtggtatatgaccttaaaaaaacttgaaaacccaaataaatatcatccattggtttcccattgaccatattcttatttacttcctcaaaaactcttgcaaatgaatcaagacatgatttctacttacagaaaataggttgcctttccccactgagttatgttgccatttacatatttggtcttatagattaaggtgtttgaactcaaaactaggagagtattttagaaccacagtaagcttataaagcccaactcctagtgtttgtgttaacaggtaaaggaatatcatggataaatattatccacagatgatcctcaaaccttcctttacctatcgtttgaacacatttcttcatcagaaactatataccagaggaagaaaattgactaaaatcacttttcatctacatcaagtaatcccagattaactctattttatgctaatcgcctcttcattccaaatttctatggcacttagattatcaattttttaataataatattgttaatataatatgttttaagtcagtctctggttttcatataccttgtgttttgctacccccaaaagatcacaaactcctacgtaagcatgaaatatattttgaggttctctttttatatatatcttattctataatgtctggtaatttacaagttctgtacaatgtagatgcttagtaaccatttgttaactaattttataccttctcatgggtataactactttgaaaaaggcaaaagaatatcagcaggaaagaaatggaagggaattcatgatggcaagtactggtgatgaaattatgcctaaactgaatttatttcccaaattccagaataggctaatccatcctttctgctaaaggaagctgaataccccatcccctgcttttttttttttttttttttttccagacagagtcttcctctgtcacccaggctggagtgcagaggcacaatctcagctcactacaacctccgtctgtcgggttcaagagattctcctgcctcagcctcccaagtagctgggaccataggtgtgtgccaccacaccaggctaatttttgtattttcagtagagatggggtttcgccatattggccaggcaggtctccaactcctgacctcaagtgatctgcctgcctcagcctcccaaagtgctgggattacaggtgtgaaccaccgtgcccggccaggaagctgaatacctattataagtgaaatgtaacttgaactctctgcaaagaaattgttattctgaaatcatctgccttactatgaagtgacagttctctaagaaatgtgttacctttttcctaaaaagagaaccttcactcctttagcagtcaagtgagttaatttcctttcagttttatcaaaaccatttccaaactccagcttagcttttcctgtgaagacagtcaactctggtggtatccgtacacacagactggtttgaaaaaaaatctctgggaaaattaaacctagggttcttttgaaagtaactgattggattcactctaaataaatttatttttgacagataactgagagtatttgtgactggctaacagcaggaactagagtagacttcgtagtctagcaggagttaaaacttgagaaatggccactgatgatgaaaacccatagctgatagataagtaaccatttggagtactacaaaagaaaagccactgataatttattgtattttttaatccccattacaaaaaaaaaaaactcttgggtgcatttataaacacacagacactaaacatgactgggatcacacctgggctattcagcttctccaaactcattaactgaaaagatatagattaattggagggagttcagagaagagtaacaaaaatgattaaggggccagagggattgatttatgagcaaagattaaaagaattttgtctatacaatttaactaagtgatgactaagggggaagagggtggggatacaactgtctgaagggtgtaaacaccaaggagagaggagaataatttactatgcaacatgagaatataactagggctaataagctataattacccaaaggaataacagaatacatatttcagggaaactcagaaccatgagaccgccaacttgtttctcaaggagacactggcagatacttataacattagtctcatccagattaacaagtatgtggtgtgaaacaatcattttatgccattgagctctctctttccccaccctcttcaacagtcttgctttttacattattgtggcatagttcaagtccagcctagtgcaccggtctatatagttttatctttgttagtgccgataagtcaaagtttaattccaatagtggccatacaagagcccttccttttggatttactgtgaatttaattgaaaagcatcaaaataaggaatcatatctgaagaggagaaaatcttggattctgcttcagaagtcatagtatttgtgttttggatctccaataataaactttcaaattatatttaatgtctagaaaagttcaattttagcattattgcaagaaaaaagacactaaaaataaatctttgtaggcttcatgatttgtgtaaactttggaatgtggttcttcagaaaacaaattagtctgtgggtaactgcaggctaagttatttggctaattcctattgtgctatcatgacattccagagcattgctatttaactttgccagataagattttgcatgtcactgcagtgagagcagcttcttttgtatgcatacttttctccttcttttcctttgtgttgggaatcttcatagggtgatcccagtctagaaataccattttttcccttcaccattgcattgacaagttcttctggttttatgttaaattttatacttccttgtcaacatttctcttaaataatatattaatgcaatattttaaataaaatttttatataaacgtttaatgttataatagttttacatttacagaaaagttgtggagataatacagagtccccatatactctatccccagtgtgcccctattacattagtatggtacatttgtcatatcaaatgacctaatactgatacattattattaattaaaattcatactttattcactgtttttagtttttacctaatgtcctctttctgttccaagattccatccaagatgccacagtacatttagtatccccttgactatagtaatttctcagactttccaatgaccttaacagttttgaggagtactagttaggtattttgcagaatgtccttcagttgggatttgtctaatgtttttctcatgactagaatggggttatgggcttttggaaggaagactacagaggtaaaatgccatttgaagcacatcatagcaaaggtacatactatcttcaacttggggaagctgattgaaaaaaaaaattttaagtacatagtatcaacatgacttatcactattattgttaaccttggtcacctggccaagtagtgtttgtcagatttctccactgtaaacttattttgccttttcatatttcactgtttgtaaggaaatcattatgcacagcccatgctaaaggagtgaggaattaggctccacctccttgatggtgaagtatctacataaattatttggaattcttctgcagttgatctgcctattctgacactatttatttatttatttatttatttatttatttatgtctagataaagtgatatttattttatactttgggttataatccaatacgctttattctgttgttcaaatcattctggctttggcctttgggaggtctttcagttggctcctgtgtccctttgatgtaccctcatgcatgtgggcttttattgaacacttcttaacttgatggcactacaagatgctacaggttcatatgtatatttcctgccccagttagtcctatgatcacccaattctccaaggatctctggttccttttattgggtattacaaaacaagatctgagtgctagatgtgctcattgctactgggtgtcattacttctaggccttctcagctgacagaggaagaaaatgtatgtgtatactagcccatgtatgtatacacatatctatgaatatttccatatgtaaccatctgggtctttactaagctaaacatgagttcatactgatgtccccagcgctaatacaataccacatggatcattctaaccttctctcctgcttgcgtgtaacttcctgttgccatccaccatccatttacttgatcatccgattccaatttgtggctatagtggtttcaggcttgttaattcacacctctgtggggacaactttatcaaatatagtagatgcttatctatggttccttttgtctttagtcttacaaactcatttccaaaattacttaggttgggcctttttcccccttgtccttcagagaagttgtttcatacatataattagattcttttgtcaaattctgtatcccatcctgagatcaatcccctgatgacttcttcttagattattttttaacttttgcatacattaagatttactttttggcctgtaaaattatgtgaagtttgaaaaatgcatagtgttgtatatccaccattacagtatcatacggaatatttcatcaccctaaaaatctcctgtgtcccacctactcaaccctccctcctcctccacatacctctgacaaccactgatcatctgtataccatctctacagttttgccttttccaaaatgttgcataaataggatagtgaagtatatagactttccaactggcttctttcacttggcaatatatattttacatttagccatgtctttgcatagcttgatagctcattcctgttttatcgctgaatagaattctattatatggatgtaccacagtttgtttattcattcacctattaagtgacatcttggttgcttctaattttggtgattatgagtaaggctgctataaacatttgtgtgcagatttttgtgtaatcgtaagtttcaaatcagttgggtaaatacaaaggagtgtgattgctggatcatatggtaaaactatgtttaactttgtaagaactgccaaactgtcttccaaagtggctaaccatttttgcaatctcaccagcagtgaatgagggttcctgttactatgctttcttgccagcaattgatattatcagtttttgaatttcagcctttctaatgagtgtctaatgatatttcatttttgtcttaatttttatttcactaatgacaaccttgcccacctttgagtggttataaactatgaatttttaaacaatagttttagttttactaattctctctttgttagaattgagggaacaatgctttcaaagtgttaggctttttatttatattagaaaaaggtttaaaattcaggctgctacctttttataaatgtgtcgatttgtgcttctgtactaattagctacaacgtaggcaaaggaagcatccactaaagtgaatgctaagtcaccagtggcagacagtgaatcacaagaaccttattggattgttgtgcacaaagtagagggagttttgttggtaagcaagatgcctataagattattgtttttctggatgtatccgggacttcattttattcttttttattcttccctctctcattaccatcaccacacacacacacctttctgtcctccccacctaaacatggaaacagcagtaaggaggactaaaatgtaatcagaatatatatgcagcatgactttttcttgctttaggaccagataaccatagtgactttcttttttcctattccaatgtgactagcggataaatgatttctttcacaactgttagttgtatctgattttgatggcctttcttaaaattttactttaagttcctgaatacatgtgcagaacatgcaggtttgttacataggtatacatgtgtcatggtggtttgctgcacctattgactcgtcctctaagtcccgtccccttgccccccacccccaaacaagccctggtgtgtgttgttcacctccctgtgtccatgtgttcttattgttcaactcccacttatgagtgagaacatgaggtgtttggttttctgttcctgtgttagtttgctgagatgatggcttccagcttcatccaagtcccttcaaaggacatgatctcattcctttttatggctgcgtagtattccatggtgtatatgtgccacattttctttatccactctatcattgataggcatttgggttggttccatgactttgctattgtaaatagtgctgcaataaacatacatgtgcatgtgtctttaaatcagtagaatgatttatttagatgatttatttgtagtagaatgatttattcctttgggtatatatccagtaatgagattgttgggtcaaatggtatttttggttctagatccttgaggaactgccatactgtcttccacaatggttgaactaatttacattcccaccaacagtgtaaaagcattcctatttctccacagcctcgccatcatctattgtttcctgactttttaataattgccattctgactggcatgagatcgtatctcattgtggttttaatttgcatttctctaattatcagtgatgttgagctttttttcatatgtttgttggctatgtaaatgtcttcttttgagaattgtctgttcatatcgtttgcccactttctgattggggttgtttttttcttgcaaatttcagttccttgtaaattctggatattagacctttgtcagatgggtagatcgcaaaagttttctcccattctgtaggttgcctgttcattctgatgatactttgttttgctgtgcagaagctctttagtttaattagatcccgtttgtcaattttggcttttgttgcaattgcttttggcattttcgtcatgaagtctttgcccatgcctgtgtcctgaatggtattgcctaggttttcttctagggtttttatggttctgggttttacatgtaagtccttaatccatcttgagttaatttttgtatgtggtgtagggaaggggtccagtttcaaatttctgcatgtggctggacagaactctcaacacaatttattaaatagggagtcattttcccattgcctctttttgtcaggcttgtcgacaatcagatggttgtagatgtgtggtgttacttctgaggtctctgttctcttccattggtctatatgtctgttttggtaccagtaccgtgctgttttggttactgtagccttgtagtatagtttgaagtcaggtaatgtgatgcctccagctttgttctttttacttaggattgtcttggctatacagggttgtctttgattccacatgaaatttaaagtagttttttctaattctgtgaggaatgtcaatggtagtttgatggaaataacattgaatctataaattactttgggcagtatggccattttcatgatactgattcttcctatccttgaggatggaatgtttttccaattgtttgtgtcctcccttatttccttgaacagtggtttgtaacaagttcttcttgaagaggtccttcaaatcccttgttagctctattcctgggtattttattctctttgtagtgattgtgaatgggagttcactcgtgatttggctctctgttgtctatttttggtgtaagggaatgcttgtgatttttgcacattgattttgtattctgagactttgctgaagttgcttatcagtttaaggagtttgggggctgagacaatggggttttctaaatataaaatcatgttgtctgcaaacagagacaatctgacttcctctcttcttatttgaatacccttatttctttctcttgcctgattgccctggccacaacttccaagactatgttgaatcagagtggtaagagagggcatccttgtcctgtgctggttttcaaagggaatgtgtccagcttttgcccattgaatatgatattggctgtgggtttgtcataaatagctcttattattttgacatatgttccatcaatacttagtttattgagagtttttaacatgaagggatgttgaattttatcaaaggccttttctgcatctattgagataatcatgtggtttttgtctttggttctgtttatgtgatggattacatttattgatttgcatatgttgaaccagctttgcattccaggaatgaagcaaacttgatcttggtggataagttttttgatgtgctgctggattcagtttgccagtgtttttattgaggatttttgcatcaatattcatcaggaatattggcctgaagttttctgtttttgttgtgtctcttcccagttttggtatcaggatgatgctggcttcataaaatgagttagggagtagttcctccttttcaatttggaatagtttcagaaggaatggtaccagcttctctttgtacctctggtagaatttggctgtgaatccatctggtcctgggctttttttttttttttggttggtagtctattaattactgcctcaattttagaacttattattggtctattcagggattcgatttcttcctggtttagtcttgggagggtgtatatgtgtccaggaatttatccatttcttctagattttctagtttatttgcatagagatttttatattattctctgatggtagtttgtatttctgtggggtcagtggtgatatccccattattattttttattgtgtccacttaattctgtcttttcttctttattagtctagctagtggtctattttgttaattttttcaaaaactcagctcctggattcattgatttttttttggagggttttttgtgtatctgtcctcttcaattctgctctgatcttagttatttcttgtcttctgctagcttttggattagtttgctcttgcctctctagctcttttaattgtgatgttagggtgtcgatttgagatctctctagctttctgatgttggcatttagtgctataaatttccctcttaacactgctttagctgtgtcccagagattctggtacattgtctctttgttctcattggtttcaaagaacttcttgatttctgctttaatttcatcatttacccaggagtcattcaggagcaggttgttcaatttccatgtaattgtgtggttttcagtgagtttcttaatcctgagtcctaatttgattgcactgtggtctgagagactgtttgttacgatgtcagttcttttgcatttgctgagaagtgttttacttccaattatgtggtctattttagactaagtgccatgtggcactgagaagaatgtatattttgttgatttggggtgaagaattctgtagatgtctattaggtccacttgttccagaactgagttcaagtcctgaatattcttgttaatttttatctcattgatctgtctaatattgacagtggggtgttaaagtctcccacgattattgtgtgggagtctaagtctcttcgaaggtctctaagaacttgttttatgaatctgggtactcctgtattgggtgcatatatatttagaatagttagctattgttgcattgttgcctttaccgttttgtaatacccttctttgtcttttttgatctttgtttttttaaagtctgttttgtcagagactaggattgcaacccctgctttttttgctttccatttgcttggaaaattttcctccatccctttgttttgagtctatgtgtgtctttgcacatgagatgggtctcccgaatacggcacaccaatgggtcttgactctttatccaatttaccagtctgtgtcttttaattgggccatttagcccatttacatttaaggttagtattgttatgtgtgaatttgatcctgtcatcatgatgctatctggttattgtgcacactaattgatgcagtttcttcatagtgtcattggtctttatattttggtgtgtttttgcagtggctggtactggtttttcctttccatatttagtgcttctttcaggagctcttgcaaggcaggctggcaataacaaaatccctcagcatttgcttgtctggaaaggattttatttctcctttgcttatgaagcttagtttggctggatatgaaattctgggttgaaaattcttttctaagaatgttgaatattggcccccaatctcttctggcttgtagagtttctgctgagatgtccactgttagtctgatgggcttccctttgtaggtgacctagcctttctctctggctgcccttaacactttttccttcatttcaaccttggagaatctgatggttatgtgtcttggggttgatcttctcatggagtatcttagtggtgccctctgtatttcctgaatttgcatgttggcctgtcttgctaggttggggaagttctcctggattatatcctgaagtgtgttttccagctttttgattgccttttaacactaatttaggtccttcctctctgagtatacctggtgctaccatgttgccccatctctccccaagctgcaaacttgtctttctccctttgtttccaattccatcttacccattctatatgccattacttcagggtcacactaggtaaaaaacaataatagtaattgtctaaatcaattttattttaaatgttaggggggaagaatacaactaacattaattgaacatctacaatgcaccaagcacttttatacatgttctcatttaattctcacaacaatcccatggtgattgttatttctgttgtatagatgccattaatttagaggtaagtggcatgctttaacccttttgtacatactattccgtctgtctaggataccccttcagttccatctctatcgagcaaactaccaaaccttcaaaagccacttcagatgtcatctccctagctggtggtctcagcactgcccatgtcaattctgaaaagactctccaagtaattctgatactggcccctggttaagagtcatcatatgaaacaatactgtgtaaagagcaagagccacgtcttactgatatttgtattcctgttgcattgcagagtctattttgcattccacagtagtattttggtcagtgtttattgaaggaattatttgaggtttatggaaatgcccatgttatgttgtatgttactgggggtgggtagattttgaaaaattcaagtaaatgtattcagataaatgctacatctctggggagcagtagaagtgaaaggtggtgataactatgaatgaaacccatataaacacagaggcaacaatttttagaaagaagagaatgcttatcatatttttattctttttggaaacaaactacttctctcataatgcaaactaaaaaaagtaaaatttgataaagtctgtttggctggtacaaatacacagcacataattgtaaaccagggatatttccttgggaaacggattgccatcagaaaaagagactgcatgaaatgtttaacatttattaaagtggcataggttaaagtgttaaatagctgaaaaacactgaagtaggaactcatagaaaagtttgggtagcctactatcctttataaaaagcagggtctttgttgattcaaaatacttggttgccttgggctctatggtattgaatgttgctaaaaataaatgcgccacctacttgcacttagaaatttcttcattctataaaagtttacattgtgttgtaacagaatttgacctttattggcaagaaataatgtaaaacatttctaatcaattctcaagcatgatatggcagcactttccacacaactaggtaccagctgataagagatgagatctctgattactatttcagcagttaccattagtacaagtaaaaatgaatattgtgactggcaagtgctcaaggattttagtactaacataattatttattgcttagaacttggctctgcatggtccaagttcaatgtcaatttaagaccccagcaagatactgtacagctgacttcatttgccaaagaaatttgaaaacttttttaaagctattaaaagcattcttgctgttttttggcagtgctaggtagaacttggctcatcatggagctgggataatcacagagtgagcgaatgataatttaggtccttaggcaaacatacaagctttgaagcctgggtatttctaattgcatgcctagtacctgattgacatgattctgaggttaaacaactaccctgagaagctgctcctagttgccgattgtttaccagtgaccttccactcctacacatagaattgtgtttcacctactgacagtggtctgccaaagtccaggatgaatcttcctggagtgtagattctgctcagggttaacagaaaacacttcacttcattctatttttgtgtgtgtgtgtgtgtgtgtgtgtgtgtgtgtgtgtgtgtgtgtgtgatgtataatgcaaaattcttctaaaatgggagacttcaaagaaatgttaggacttaagcctgtccctcccactcctgccatggggagacggcatttggaagtgtggagaatcttaaaaacactgctctaagttatggccacttttctggaatgctgttatctctcacctctgcccagaagtatcctgcttatttttcaaaagtcattgtccccatcttctgtaccccaagcagagttaacacttctctgcggctccgtagactttcctttatgaacctcatatggcattcatcccattgttgtgattgcctgtttgtcttctcactaggtaggtggtgagcctcagaagaacaaggtctacaggttctttatatcctcagtgccttgcactgtatttgactagagcaagtaactagcaaacagtgaatagtgaataggtagatggataactggatgatagaacagacaggaaaatgtccattgatatgtccacccacgtgaataagattctgagctcctctcctaatattctagtttaggcctctgaatatagaaatgggtgttcactgggctgttttcaacttgcatatcagttatacccttacttttaatggggaaatatcaatgtaattcattctattaaggctcaggaagaaaaatcatatgatcatatcaattaatgaaaacaaagtatttaacaaaatccaataccaattcatgatttaaaaaaaaaaagaaactcccaaccaactaggagtagaggggaacatccacaaattgataaaggacatctacaaaagttctacaggtaacatcatactttatggtgaaagactaaatgcttttcttctaaaatcaggaacaagattaagatgtctgctctcatcatttctagtcaacattgtgctggaggttctagccagtgaaataaggaagcaataaataagaggcaaccaatttagaaaggaaataaaactgtctttatacacagacgacatgattatctttgtaaaaagttgtaagaaatccacaaaacaactaccagaactagtaagtgaatacagcaagttcacaggatacagggtcattattaaaaatcaattctattcctatatactaggaataaacaatcagaaattgaaaattttaagaataccattcttaatagcatcaaaaatatgaaatattaagatgtcagttttcccaaaattgatctatagattcaatgcaatttaaattttttataggaactgataagctgatctgaaaatttatgtggaaagtctgagtacctagaatatcctaaacaactttgaaaaaagaacaaagttggaggacctatgctacctgatttcaaggcttattagaaagctacagtacatagtgtttttaatatagacagtagatctggttgcagaatagtgagccaagaaataaacccacacatatatggtcaaatgatctgcaacaaaagtgtgaagcaattcaatggaaaaattatatttaaaagacaaaatacagcatggaagaaaatatttgcaaatcacttatctgataaagaactgttatcaagaatatataatgatcttttaaaaaatcaataataaaaagcacacaactcaatacttttaaatggaagaaagagagtcagggacaatggtggatatctgtaatcccaactacttgggaggctgaggtaacaagatcacttgagcccagtttgaaaccagcctgggcaacatagccagatcttgtctctaaaaacaaataaacaaaaaatttaaatgggtgaagtatttgaaaagacacttcactaaagaagatatatgaaaagatcctcaacatcattagccatcagagaaatgcaaattaaagccataatgagagactactacatacctattagaataattaaacttaaaaagactgaccataccaagttttgatgaggatatgagaacctgaaactctcatacacactgctggtgggaatgtaaaatggtacatccactttaggaaatagtttggcagtttcttataacatgtacttaccacatagtatatgttacccaacagttctactccaaggtatttcctaagagaaataaaagcgtatgtccacacaaagacttgcacaccaatgtctgtaacagttttatttgtagtaactaaaaactggaaacaaatcattttgtccctcaacagatagtggataaacaaactctgttacatccatgcaacagaatactacttatcaatgaaaaggaatgaactgatacatattataacgttagaatctcaaactaattatgctgagagaaagaagcccgacaaagtatcttgtgtgatgctatttatataaaattctagaaaatgaaaactgatctatagtggcaaaaagcagatcagtcgttacctggaaatgcagagggcatcagagactgggctgagtgggaagggattacaaaggatcatgaggaaacttttgggggtgatggatatccttgttattttgattgtgatgatggtttcacaggtgtacatagatgtacatacatatgtaaaaacttaaatatgtacaatttgttgtatgtctataaagccgtaaaaatgatctctgtggctgaaaatgaagctggttataacttaatctggagtgtgtttcaggtatcagtgggttataagagaaaggatatagataggctttgaggctggagttaaagaggcaggttaaataatagagacgggctattctttagttggcttcttgccagaacgctttttcagataaaggttctgagagactgatttaaatttagtaatggcaaaggaagatttctgttccaaggttactaattggtttttaaattgccatatgattatttttatatcttatgagtaatacatgcacatagtttttaaaaatatgaactaagtacctaaaagtttataatgcagacaatgtttcactgttccaaccctccgaatcctaatcctctgagattacctttcactctattaactgtttctgtttagttcttctattgactgcttccatatatactgctatttcttaattcatctattttacgctttattaactttgtaatttaataaatgaggctataactcacttatactatctcttgtcccaatttagttatgatgctttttagttcctcttctttttttttttgaggaatatacttagacctttatttcttgtttcgtaaactatagacagtatctcttagttctttgtaaaaactaagagtttgtaaaaagaggccattagttccctttatctctctcccctacctgccaattctagtcatgtgtacttttactttttacattgccaagagtggtaatgtttatgttttgctctacatttataattaactatctctataattaaatatcctgtgcttttatatattggttatttccagaagttgaaaatcaatatacagtgtttgtactattgttaattatttaaaatttttctctcttctgtcaagtgttgatagtattacatttcttaatttgtaaaacttgtttttttctggattttctaattacctttattttttcttgcatcgtctgctacattcataagtttctctaatttcttaaagatggataggcctggcgtggtggctcacgcctataatcccagcactttgggaggccgaggcgggcagatcatgaggtcaggagttcgagaccagcctggccaacatggtgaaacaccgtctctactaaaaatacaaaaaattagctgggtatggtggtgcctgtaatcccagatactcaggaggctgaggcaggagaatcgcttgaacccgggaggcagaggttgcagtgagctgaaatcgtaccactgcactccagcccagctgacagtgagagagaccatctcaaaaaaaaaaaatggataaaatggtgaatccttttccctgtctttttcttgatgcctctctcttggagccccccttccttccattcagacgaagtgttccttaggcctctactgtatggctgggacttacttttattagtctttgcaatattaaaatgtcatgtttttgttatcagactcaactgatagttggttaggacaaaattataggtttgaaataattttctgtcataattttgaaggcattcctccattgttctctctaagagccagcgttgctgatgagatgaccaagccattccaattcttgttcccttaactattaatgtttttcctctctgggagcttttaggatcttttctatatctttgctgttctgaaatttcataatgtgtgtaggggttgagcaaaatggtttagtaccccagatataaggcctgcacctcaataagccccaactatgtaaatagagccattatactgggggacctctaaattccagatagtagaggtctttgttttacagcattaatgcccacattagttacttcaattcttcttagacaatttattcaatctctttagagaagaaccttctgatttttttctttgccttgggaatcaatgcctgaatactagcagttctatatgcagtggaggaaaatgattaatatacagattttcaatgaatttctcatatttcattttcaccctctgccttacttgacatttccaattttcaaacttttctgtgatcctacagggcagaccaacatcctcccaagctgtaagccccctctgtcattttatctgccaatctttatcagccagcatcctattcaatgtctgtctatcagaaatgtattgggatctcttttctgctgactccctctactattgtcttcattatatcttttttattgtttaatgtcattgttaaatttttttatttttaatttttgtgagtacatagtaggtatatatatatttatgggttacacgagatattttgatacaggcacacaatgtgtaataatcacaacaaggtaaatgcagtaaccatcacttcaagcatgtatcccttctttgtattgcaaacaatccaattatactcttagttttttaaaatgtacaatattttaaaacgtacaataataaaatgtacaatgattgttgactgtagtcaccttgttatgctatcaaatactagatcttattcattctatctaactatattttttaccctttaataatccctactcccccacccattactacccttcccagcctctgataaccatcattctactctacatccccacgagttcagttgtctttattgtttagctcccacaaatgtgtgagaatatatgaagtttgtctgacttctttcaattaacgtcacgacctccatttccctccatgttgttgcaaatgacagtatctcattctttttatggataaatagtactgcattgtgtatgtgtaccatatcttctttatccattcatctgttgatagatacttaggttgcttccaaatcttggctattgtgaatagtggcacaataaacatgggagtgtagacatctctttgatataccgatgtcctttcttttgggtatatacctagcagtaggattgctggatcatatatggtagttctatttttagttttttgaggaacctccaaactgttctccacagtgattataataatttacattcccaccaacagtgtacaagggttccctattctccacatcctcatcagcatgtgttattgcccgtctttttttataagaaaacatttttgaagcctttatttacaaaagctttaaaaacaagtaataccctctgttttgaaaataatgttttgtttaaaaaggaccacccagttacagcactgtaatatcatgagtaaagaatgtacaagggagacaaaccaatgtgactaacatttggagatttgctaatattattgattgaagtataggtaatacacattataacttgtagtcaatcatttcagggtagggttaatgattaccgaaaagtcttcctacatcctacacatgctctggtctggtcacatattctgcatggctaaatatttcacagtctcttttgtcaatatatgtaaaatagattgcaaagatatacacaaaaaaaacaagcattacactcctcaggtaattttattagctctctctctctatatgacaatatatatatattctcatatattctcaagcatcaaaatgttatacttgactgaagatttgtttcagaaaatattttatcctttatttatgtactcatatatatatgagtacattatatatatattatatatatacatttatatatggattttgttttgtaccaaatctctccattatttacctttgtagcaactaggaaagcacaatttttgacttctaatttaatttggtacaaaatatacctaaagacttgttatctttggattttaaaaaaaatcaatttgtataaccaacaaatcaagagcatcataagtatggctacgaaattaaaaaaacaagggtaaacagtgatggaataaaaataagcagatcaagggaagtgtgctatcataaagtaactgtagcttcaacatcttgagtaccagtttcctggcagatactaagtattcaatcacaaggaatttttcctgaagggggtaagactggtttgaaaagtcttcagtcacagagcagcctacacatgccaattaaaaactgacagacactagatgtgcttggaagattaaacattatgtacagaaacagcagttactaagctcctcagtagtttcttgtcttttttttagtttcactgaattgacagtttgcacaataaatgtgctacattctgtgggtcaaaaccgagtaaatgctgtgtaaagttggtagatggtcatttttccagctaagatcaagtaaaaacaacatttctgataaaacagaggttttgagttagaatcactctccaaagtacaaaactgatggtccacaatctcaaatagctaaaactcctgcagaatggaagggagagacatgaaacagagaaataaattacagtcagtgctagttaatttaggaaaagggagaaataaaccaaactcccaagtaggtaaagtttatcaaaatattcaatgatgtagctttctccactctgtcacacacgcttgctaacaagtatattaaattaaggccaaatttaacctaaatgtgtttttttgttgttgttgtttgtttgttcttttgtgggtttttttgttttctttttttaatctgagataggaacgatcatacttagtactgaaaggcagacaataaaatgggccatgaaagggcggggggaagggactgtctgttgttcaaaggattcaaccagagataaaacctatatacaagcatgtgtgtagctcaaaataaaataaaaataaaaggactatttcatgtcatgactgcttgttggcttcttcttcatatgcattccctgtgccattctgtacataggatgaaccagaaccaaggccatacaaatgaccacaatatttggcatcatcagtatgatcttcaaagaacattcctctcattttgaaaaaggccattcctgtcagcaatgatttagatcctgcctgatgtggtggtcctatctatgccagctctaactgttctgccacctcctgtaatccatctttgagatgtttgcagctcttcatgaggtacttcacatcataaatgacaggtaaaaacaatcgaaggatctcaaagaagtcaagttcttcttcaggcaagttagagttggtcagcattttgattaaatagccaaagttgtaactgctgtgaaatgacaaccatttgaccccttcacagaggaccactcctgaagtcataagaagttctgcaaagtactgggtctcaattccttcctcatcatgttttttaaactggataccagatgttgttagtagctctatagagttctgggcatacatgtcctctgtcaaattaaatttaaaattaaactgccaagttgaagttcctggagggtattctccttgctcatttataaatgtcagtcctagctgaattatctttaacaagtctacattacaccgcaatagttggtattgatagtcagcattgctcctgaatcctccagtgggtcttgcaaccacacctggaaactcggtgtccatagcaacgtaattatattttcggataacttgatgaattttcttcatctcttcatccacgttgcaagcccaaacttcacaaattctttggctatgatgtacagttgctgctggcatagtgagggcacaagggagtctagatgccaagcatcaaaatgttatacttgattgaagatttgtttcagagaatattttgtcctttatttatgtacttgtgtcactgagctctcactcctcctcctccccctggccatagagacagcacccggcggcagtggcagtggcgggtgccccatagacacctctcgcccagcaagggatctgcaccacaccgtggtgcgctgtcacttttcgcaccgcctgtcttttgaataaaagttaaaatggataaaggccattttcactggggtgagatgatatctcattgtagtttcaatttgcatttctctgatgatagatgatgttgagtaccttttaatatgcttctttgccatttgtatgtcttcttttgagaaatgtctattcagatcttttgctcattttaaaatcgaattattagattttttttcctatgaagtggtttgagctccttatatattctggttattaatctctgtcagatgagtactttgcaaatattttctcccattctgtggattatctcttaactttgtggattgtttcctttgctatgtagaagtttttaatttgatatgctcccatttgtccatttttactttggttgcctgtgcttgtgggatattaaatttttgcccagtccaatttcctggagttccctcaatttttttctattagtgtcatagtttgaggtcctagatttaagtctttaatccattttaattttatctttgtttacagtgagagataggagtctagtttcattcttttgcaaatggatatccagttttcccagcaccatttactgaagagactgtcttttccaaatgtatgttcttggaacctttatcaaacatgagttcactgtagatgtatggatttattccagggttctgtattctgttccatagtctatgtgtctcttttaatgctagtaccatgctgtttgggttgctatagctctgtattacaatttgaagtcaggtgatgtgattcttccagttttgttctttttgctcaggatagctttggctattctgggtcttttgtggttccatatacattttagaattttttttatttccatgaagaatgtcattgatattttgatagggattgcattgaatcagtagatagcttggggtactatgaatatttaacaatattgatttttctaatccatgaacatggactatcttttccattttttgtgtgtcctcttcaatttcttacgtcaatgttttatagttttcaatgtagagatatttcacttctttggttaagtttattcctaggtattgtattttatttgtggctattttaatgggattactttcttaatttctttttcagattgtttgctgctgacatatagaaatgctgtgttgatttttttttatcctgaaacgttactgaacttgtttatcagttctaattgtttttttggtggagtctttagttttttccacatataagatcatttcatctgcaaataaagataattcaactttgtcctttccaatttggatgccctttatatctttctctcatccaattgctctagccaggacttccagtactgtcttgaataacagtggtgaaagtgggcatctttgtcttattccagatcttggagaaaaggcttccagtttttccctattgcgtatgatactaactgtgggtctgttatatatggcttttattgtattgaggtatgttccttctatacccagtttgttgagggtttttatcatgaacagatgttgaattttatcaaactcttttttcagcatcaattgaaatgatcatatcatttttgtccttcattctgttgatatgatgtatcacattgattgacttgcatatgttgaaccatccttgcattcctgggataaatcccactttgtcacagtgagtgatctctttaatgtgtcgttgaattcagtttgctagtattttgttgaggatttttgtatcaatgtttatcagggatattggcttgtagttttctttttttgatgtgtttttgtctggttttggtatcagggtaatactggccttatagaatgagtgtggaagtactccctcattctctattttttggaatactttgagtaggattgatattagttcttttttaaatgtttgataaaattcagcagtgaagcaattgggtcccaggcttttctttgctgagagatgttttattacaacttcaatctcattatttgttattagtctgttcaggtgatggatttcatcatggttcaatcttggtaggttgtatgtgtctaggaatttaccagtttcttctagatttttcaatttattggcatacagttgttcataatagcctataatgatcttttgtatttcttcagtgtcagttataatgtctcctttttcatctctaattttattactttaggtcttctctctttttgtagttagttgggctaaaggtttgttgatttttttatcttttgataaaaaaacttttcattttattgatcttttgtatttttatttcaaatttctactctaatcattattatttcttttcttctaattttgagtttgcttcggtcttgcatttctgtttcttttttaacttttgtgagtacatagtaggtgtatatatttgtgagttacaggaggtattttgatacaggcatgcagtgcataataatcacatcatgataaatgaggtatccatttcctcaaacatttatcccttgtgttacaaataatacaattatactattttagttagttttcaatgtacaattaaatgcaattctagttctttaagatacatcattaggttgttcatttgaaatttttctagttttttattgtaggtgcttattgttataaactttcctcttagtactgctttcactgtatcccataggttcttgtatgttgtgtttccattttcatttgctgcaagaaattttttaatttccttcttagtttcttcattggcccactggtcattcaggagtatattgtttaatttccatgtgtttgtataatgtccaaaattcctcgttattgatttctagttttattccatcatggtcagggaagatacttgatattatttcaagtttttgaatgttttaagacttctcttgtggcctaacatatggtctatccttgagaatgatccatgtgctgagaagaagaatatgtactttgcaacccttggatgaaatgttacgtgaatatccattaggtccatttggtctatagtgcagattaagtctgatgcttctttgttcattttctgtctggatgatgtatccaatgctgaaagtgaagtgttgaagtctccatctattattgtgttggggtctatctctctctttaactctaataacatttgttttatatatctgggtcttccagtgttgggtgcatatatacatatatttaaaattgttatatcctcttgttgaattgacccctttatcattatataatgaccttctttgtctcttttatagcttttgtcttgaaatatattttgtctgatagaagtatagctattcctgctaatttttttgtttccattagcatggaatatcttttcccatccctttattttcagtctatgtttgtctttatacatgaagtgcatttcttgtaggcaacagatcattgggtcttgattttttatccacttagccactctatgttttttgattgaagattttagtccatttacactcaatgttattattgataagtaaagatttactcctgccattttattacttgttttatatttttgtggtcttctcttccttctttcctttcttcctgtcttccttctagtgaaggtgattttctctgatggtatgatttaatttcttgattttgattttttgtgtatctgttgtacttttttatttaagattaccactatggttgcaaataatatcttataaccatttattttaaactgatggcaacttaacaatgattacatatacaaacaaactaacaagcaaagagaaaacgaatagacactctacactttaacttcatccccccactttaaaaccttcttttctatttatatcttattatattgtctatgtcttgaaaagttgtcatagttattattttttattggttcttcatttagtctttctacttaggataagagttatttacacaccagagttacaatgttataatattctgtgttttcctgtatacttactattaccagtgagtttcgtatgtgcaggtgattatttattacttattaatgttcttttctttctgattgaagtactccctttagcattttttgtaggacaggcctggtgttgaaatccctcagcttttgtttgtctgggaaagtctttatctctccttcatgtttgaaggatattttcactgaatatactattctagggtaaaaggtgtttttttttccttcagcactttaaatatgtcatgccactctcttctagcctgtagggtttccactgagaagtctgctgccagatgtatacagctccattgttatgttatttgtttcttttctcttgctgctttcaggatcctttctttatccttcacctttaggagtttgataattaaatgctatgaggtagtcttttttgggttaaatctgcttggtattctataaccttcttatacttgaatatggatacctttctccaggtttgggatgttctctgttatccctttgaagaaagtttctgccctgatctctctctatctcttctttaaggcaaataactcttgtatttgcccttttgaggctattttctagatcttataggcatgcttcatttttttgtattcttttttcttttgtctcctctgactgtgtattttcaaatagcctgtcttcaggcttactaatttttgcttctgcttgatcaattctgctagtaagagactctgatgcattcttcagtatgccaattgcatttttcagctccagaatttcttctttattcttttgtttcaatctctttgttaaatttatctgataggattctgaatttcttctctgtgttagcttggatttcattgagcttcctcaaaacagctatgttgaattctctgagaagtcacatatctcattttctccaggattggtcaccaatgccttatttagttcatttggtaaggtcttgatgcttgtggatattcatcgatgtctgggcattgaacagttacgtattgactagtctccgcagtctaggtttatttgaacccatccttcttgggagggctttccaggtatttgaagggacttgagtgttgtgatctaagtctttggtcactgcagctttagggccaccccaagcccaataatgctgtggctcttgcagactcatagaggtaccacctggtggtcatgggtaagatctgggagaattccctgaattgccatacagagactcttgctctcttcccttactttcccccaaacagagtctctgtctctatgctgagctgtctgaggctaggagaggggtgacacaaagcaccactgtggccaccaccacctggactgtgctgggtcagacccaaagccaagatagcactgagtctcaccccaggcctgtggtaaccactgcctggctactgcctatgttcactgaaggcccaagggctctacaatcagcaggtggcaaatctagccaagcgtacgatattccattcagggtggcaagtctccctggccccagacaggtccaacgatgccatccaggagccagaacatggagtcaggaagcataggaacctacttggtgatctattctactgtggctgagctgacacccaaagtgcaagacaaagtccttcccactcttccttaccctttcctcaagcagaagagtctctccctgtggctaccactgcctcaggcccatggtgagtactgcctggctattgccagtgttcactcaaggcccaagggtctttagtcagcttgtggtgaatgctgccaggcctgggactcttccttcagggcagtgggctcccctctggcccaggacaggtccagaaatgccatccaagagccgaggcctagaatttgggaccccaagaacccacttggtgctctaccccactgtggctgagctaggacctaagctgtaaaacaaagtcccttctactcttccctctccttttgtcaagcaagaggattctctcatagccaccacagttgggaatgtactgggccacacctgaagccagcacagctgaatctcacacaaggcccgtgttgagtactgcctggctaccactgctggtttttcaggggccaaaggctcttcagtcagcaggtgatggattctgtcaggactggatccttcccttcaaggcggcaggttcccttctgacccaggatgtgtttagaaatgtcctccaggagccagggcctggaatgggagccttaggactctgcctggtaccctattctactgtggctgagctggtatccaagttgcaagacaaagtcctctttattctcccctcgcctctcctcaagaagagggaaggaatctctcctggagctgtaagctgcactgcttttggttgagggaggggtgatgcaagcactcccttggcaccccagctgatatatcactagattacgtgcattccaagctgctgtctccaaacccagcacagcaccaggacttgcccaggaattgctgtccttgtggcctagactgcctttaaagtttatttagaaccccaaagcactttagcctacagtattagggcttgccagaactcaggttccaaccactgggatggacagttccaaccactggctagcactggtctaatgctccttccatggttgccagctgagttctgccccaggttgctttccgctgtgacagggcagcactgagtttcaatgcaaagtcacaatcactgtgctctccctccccaaagtgcagattctctctgtgccacatggccactgttgggggatgggtgagaggtggcataggtggttttaagactgtctttcctaccctcttcactgcctctttccttaatatgatgttaaaactaggtactatgatcactcatctgatttttggttcttattaaggtggtttctgtatggatatttgttcaatttgatgttcctgcaaggggaggggatgatcactgaaggctttcatttggccattttgctccacctcctccacctctgtttgtctgtttaatgtcattttaatgggatcttgggagagagaggagctaaaactgtttggttagttaccttgatgcagataactatatacttgttaaattttaaagtttatggagtttctgtggattttttggaaaatatttgtaattaggagcaattagctatgaactggacaaacctacattgtttatccatttatagaaatcaaaggattcgttagagttaaagctctgtgaaagagattagtataaagcattgaaatctaattctccattgcttcatggaaagatatctttagtccctaatactaaatcaaacaatggatatgtataaaattgactctaatgaatagggtattttgctatacttcatttcatttgtttatattttatcctaatttctttttgagtgggttgctccattgagatactatacaaaatattcatgagacaacactcagcatactttcttcactcactttcatggtcacaagcaagagtcaggaattttcctctaagaaaatgacatttccacagacatcctaatgctggattccagtcagtagccatattgaaaaaaattgtctctcaagacatttgtctctcagttttacagccactgaaatagtattggcctgccattacgtcacataatgaattattttgtatttacctgaagggaggccctggacacacctggacacatggggcactaaaatgccaagctagcagagaacagcattgcagctttggatttgtctaatctcacagtggctttgctggtctcgtgtttttcttgccagtccttttatgcccttggtgattctagtgttatagtctttaaaatcctgaatttgtgtcccaggccctttactgtttttcccaatcctcgggtttgtttcaggcttttattatggactaaatccttgctgattaacctgcctgcccctaagatacctgtatcttaaactcttctttgaattcaatctgcgtacttatagcctatcctgcctgaccttttcctctgaagttatttactgatctctgagattcactttctatactcacattcctgtgagccagtcctggattaatggtccactggccacgtatctacattcatatccttgttatctacccaagcccatgagtctatttggaccattgtttctagtctttctttcattatctgagccctagttataacagttgaactctagtctacaatgtatttcaatatcaatgtaaactgaatatcactcatctttccttaaaatttttcccactacttaatttttttataatatttggaacatttttgccttctcagaatcagtagtcatctgtttcttaatttgcttcttatttgtatcctattcccctcccccaagttctgactgttgcaactctgttttcactaactacctcacttttctctttccttcatatttatctagaatgttgtagtcagatgtggcttggggtagtttatgtggtgtaagtctccattggcagcagaatggatttcgtagaatgctattaatagtgaaattttggacaaggagaaaaaaatcctagtttaaatatattgctcaggcaatctcattttagtcataacgctactctaacttgtgctaatccagcttcataaaggtaaactgcaacatcattatcaaatatttaagagccatttaacaattcacaattaagaggttgtgtttgagctaatgttttctgaatccagagctcatttaatttataagctactcacaaatgattgcctttagtgatttccaggtactataagtggaagagtatgtttttctctttatgtgccaaagcacctttcactttagaagcatgaggaattacaaaataaataagcacacactcccaagggaaggcagtgtcatccagtatatattgttgcccttccttttattcaaagatgtcactactgatctaatccactctcatggggagcaaagactaaatcttcaaccagaagtcctttctatatgacatacatacaaaccattttttttatttgtgtctgcagctgctacttgtagagcctgtcactggatgtatttctgtgtttgacttgtggtcagctgaaagcctttgctcaaaaagttcaaaaattccatattgttgcattccaagctggtctctgctgctgttttccccagcagcccacagctatgttaatgttagttagagctattctataatacacctttagagtatttcttatgccacccctgcttatggttatgccataaagctcaccataccaaagatgctttggtttccttctgccattgtatttctacgcatgtcagcaaggaacagtgatttaatgctgatagagaccaactgacttccagaatctcagtagtagtcatcccctcttaccattttacattaagcatgactctgactctgacaataaaacagttcaccaagtagatgtgatatctgtggtgggtgtaaatttcaaagtcatacaaaagctggacccaacttatattttccattgatgaggatcaattcagtaagcttttagtttttcagctctgttctggatgttaggaatcaagctagacctaggaaacaaaaagtcagggcaggggtccattttccccctttgcattaatagttttatgtttctaataactcatctttctccttgatgtacatcttaaatagatttcaccctgtccagaggacaagtccacactggttctggacccacaaatatacctgccattgaggaggcatagcttactacctatgggggaagaaaaaatacaattaagatatataaggcattatttgataaatgtgaggggatctgttctgccccaaaatgggatctaagaaaagccagagattgaactggtctgtagtacaatttcacactggtgccattccatggtaatcttcccaagtaaaaatactttttttattttcctttctactttgtagttacttgcattgttgggcagtgatttttaagtcaaactgcctaggaagcagaattcagtgactgcttttagctctatgtgatgaaaaaatgttggttgtgtttagattccacatttagcgttactccgtaatttcagtcatcctctgacatatctacaacaagacatggcaatccctggcactcacatcagagatgtccaagatgccagtttcatttggcatttggcctgattgctgccaccaccacccccaccccactggtgacagctcccatgggatgctatgatcaatgttgaatgtccttgtttgcttactcccaggagttggcacactctgttcagcaactagcacatactgtgcttctattgttgtcacactgtttttgaaaccttactacctcctattgtgtagtgctgtcacagctacaaaaaaaccacaaaattgtttgtatgttgtttgtctatgtatattaaagatagattctagttcagtgccttccatatggtaagtactcaatgtttattcagacaacaccaccctgaatgaccttctctagaccttttgttgataatcaaagcatgtcgagttaagggttcttatgattaaaagtgcgttcaatgccatcttttgtaatcattttatatctatgacatatctatcatggatatgtaccaatgagacaaccctgtttcactcattggtgccaggatgcttatatcttgctatagtgaaatcagagattttcttgaatgtttcagggcataaatggtttaatttatttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctaggaaacaagggtgtaatcacttaataaagtgtaaagaattagatttttttcccccttgagcaaaatgcctggctgtggccaacattcctgatgcttcctcccttgtgcaataggaaagcaatattctaaaagagaagactgttttattcatatcctgcaacttgcctctggaggctatgctaatgaatgcaaaactcaagctggaattccagatattttgtgtgagcagccactgatttttgtctttaccattatacagaggatagttttccctgctacctgtaactgagatgcaaaaaagggccctgtgaatagggactctctcattttaagcagtgtttttgtgttgttttcttcttatttttattgaaaaaatagaaaccatgtgtattagtccattttcattctgctgataaaggcatacctaagactgggcaatttaaaaaagaaagaagtttaattggacttacagttctccgtggctggggaagcctcacaatcatgggggaaggcaaggaagagcaagtcacgtcttacatggatggcagcaggcgaagagagagagcttgtgcaggggaagtcctttttttaaagccatcagatctcatgaaacttattcactaattacaagaacagcagggaaagacttgctcccatgatttagttgcctcccaccaggtccctcccacaacacatgggaattaatcatgagatctgagtggggacacagccaaaccatgaactatgttcaaagcattttcatatacaggcaggcagttctcttctaatgaacacttgacttatgaatgtcccatattcatcaacaacctctcttgagggactttgaactactcttactactcatggaaggtggagttgtttctgctgtctgcagaagtttgtttctccctcaactctcctcttctgggggcttgagttctcacaagctcctattagacccttagaacagttaatacaagagtatcttttcctaatgccaccactaggatgcaggaaggtgctagggcccctgccagaactcccataggagctcagcccatgagggagcacaacaagtatgagggaatctctggaattgtagttggtaatggcggggaggttcttcatctgcatttcaaaatatcttttcctagaaatagcattgtgctgaatagcctacccttgtagaacttgggtgtatgatagattcaccaatctagaccacagccagaaatcaagcagtaaacaaatggtttctaagccactagaaaatatgcatcttacttattggaaaagccgttcaaaaccacactcattgcctgtttattctgtttgtacataagtcttattagttttaactaaatgtcaagcctatagcagattataagcagcaaatctgaaaggactggaaaagatgttacaggtaggtaaagtgaaatctgatagttgatggcaagacaaaagataaaataacattaaaaagaagtttaagcactcaaaaaccaatcacaatgaaacagtacttcacatccaccagaatggtggattgattaaaaatactgacagtaccaaccgttggtgaagatgcagagcactgggaccctttatgttgttggtgggcatttaaaatggtagtcactctggaaaatagtttggcagtttcttacaacaaataccatataacccagaggttctactcctaggtgtttacccaagaaacatgaaaatataggtctacacaaagacttgtacatgaatgttaatattagctttatttataatagccccaaactaggaaaaacccaaatgtctatcaatgggagaattcatagaaaaaatgtgatagagccatacagtgaaatactgctactcagcactaaaaaggaatgaactagtgatacatgcaacaacatgaatgaatctcactgacagtatgttgagtgaaaattcatattcattcatacatatgaaaaattgtaatggatgattgtaatctagaacaggaaaaattagctattgtgatagaaatcagaacagtagttgtctcagggtcaggggtactggagaatgactgaagggcacaagagaaaattttagggggtgatggaaatcttgatttgtcttgagtttggtggtagttacaaaagcgtgtatatttatcaaatctcttcaacccgtatgcttaaaatttgtgcattttattgcatctaaattatatatcaaatttttataaagtacaaaaatttcaaaagggaaaaaatccttcagaagatccccctgctgcaggatctaagtctaaattcctcaacatgatctggctcttacttaatactccttggcttatttctcaccattccctctcacctcctaccacttattctaagctacttatagttccaaaagttgttattctttctttttcctctgaacctttaagcacagcactcctttttcctggaattccttttccattttccatttatcactaaatcattgacatcctttaggactcacagaagtagcacacctcctccaagacgacttgttcactttcaggttgtgttagatgcttcccctcttgctcccagagaacttgaagctcctctccatcaaagcatgtattgctctataatgtaattgtaataattaaaaaaccctcaaacccatagtggactgaggtcatttaatgtacaggcaaatagtcctccacatattcagtaagccctgaattaaatcacatattataaactaatttcttttttattgcattatactaggccctatcatatactttaatattcataaacactgaagtaaatattgctattacggggtttttttagtttttaagttcacaggtacatgtgcagaatgtacaagtttgttacatacataactgtgtatcctgggcgtttgttatacaaattatttcatcacccaggtattaagcctagtatccatttgttatttttcctgatcctctccatcctcccaccttccaccctccaataggctccagtgtgtgttgtccccaccatgtgtccatgtgttcccatcatttagctcccacttacaagtgaaaacataccatatttggttttctgttcctgcattagtttgctaaggataatggcctccagctccatctatgtcactgcaaaggacatgatctcgttcttttttaatggctgcatagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaa

SEQ ID NO: 3435 - DNA, 244981 bp, human
ttccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttactagcacactccaatttatataacagcttatcaaagaagagaatcagcagacatgcttctcatacttgaaactttaaacattgtagctaaacgataattaactaggattctgactcctttatttatctactgccactccccccacaccccaatgcccagcagaagtatttagcagctgaacattgatattctgtgaaaagatgaaagaattaaacttctttaatcaaatgttggccaatactttttggcattcaggatggacagagccatttttatagactgaggattagcagaacagctgtactgtaaggtttctgtgatggcatgaaactcttacaggtgtataatggcatttagttacctaccctttgtgtggcactaaaatagttctgtctagatttaaacacagcttcctatcttctgtcttttattctttctgttttaatatttttgagcaatagaagcaaggatactagctctttacatttgttgacatcaattggaatcagtttcctagagttatgaagggcttatatgagtccatttcgtttgattcccttgggaaacataggccctaaagggaaagtgacttgcccaaggtcacataactagagtcaaaactgggatgatagttgctctaactcctagttgggtgcccattcccccaactacctcctgggaccttttgcgagggagcaagatggagctccacattagaacttttgcaaagtagagggctcagctctgcatcattttgttctactctgcctgtattttgaccacagtaagtttaaccgtgtgttccttattcttcctgaacttcactttcagatttggagtatactttgaaggaattttagcccaaattcaacttgtttattttaagttgttcaacttaagtttatcttatcttgtatattagttttagtatacaaaaataactttttaaaaaagttgattgggtattaaattaatactgctacaagcttggttaaaatttctagtgccctggtgcaccctctgctggctttacagtgacatttaattttcagtatctgctgacactcagaattctacattgtgctgacagattctgattcagtaaataaggaagtaaacagccttgtgggatttggccacgtaggtcatatttttatattttagtttttaaacacaaacaactgctgttacagcaaatcttggatggagaggaagaaagataaaaatatacacccttcaacgggcagtacattcaggtttcttaccagtttatctgtaaggagtgaaggcaagctgatgagagtaaactgcaggaagctctcatgagaccaagtgggcagaacagtcagagacacttcatgcaggtaggcaaaagtaaacctatccatacttatgagatgatgggctctgggctctcagttatgactcaagaaagggacctggaaatcactgtagatgtatgtatatcatctgtcaatttaaaaactttttaagcagggcacacaaggaagttagggcaggtaggatacagagcagagagatcagcacagttctccatgtgaaatgttagaaaagtctccctggtggggacacacttgctgatgatgaagtgagagagtcacatcagaccttccgtaatcaatcatctccttcagctggagcaaccaagtagctgagatttgtctggatagttggtggagattatctcaagagcaagggatatctcatttgtgtctgaattaggacaatatacagtaatatgatcgtcagagtaaaaaactaaaaatcactgttgatcattctgtggagatgttgcgccggttgtgattgtggtcctcaaaggccaagaatgtagtgggtatcatcaggaagggtgtcaaaaacaacaaaacaaaccacttacaaaacacttattttttccatgtacaagatcaaaagcagattggcttctacaatcagacaggaaattctggtggctgctcctcaagaaaagcctaacagctgataaaagtcctcaaaaaccccattaaattgatcaaaaggatgaagggattttctagttggtttttcagtctggatagaaagaggttgaaggaggaatatgatcaaagtctaccaaaccatgagcgagatgaatatgattaatatattggtgtaacgtaacaatccagttcaataaatagaaagcctgctgtgccagacacaatgttaagtattagacaccttttaatgtttgaaaaattattttcaagaggaggcaaataaaggtagtatcttattcaactcattgtctcaagtaatagtcaaaattatgggtagatcaatacagatttacttagaactgttagggctatttggagtatgttcctaattatttgaagtgatgtcatagatgtcaaccttaaagttctacaaaacattgcttgacataactagatagaccattagtgtatccagagttgacattacctgtgttaaggctcttcgatcaagaacataactaggaatcattcgaggtgattcaaggtgagcacaatgaataaatccaaggatttttttttttagggaggtgggatctagataaaatacctttactgtgggtttgaatacagaacttttgatcaacttgcttcattattcccatcgcattttctctctcactaactctgctgcaacccacccatcatatcctgtcttagaatcattctttagttgttattgctgttgttttcaaatacattttatgtctttacattagagctccttagaaatctgccttcatttttgtctttctccataatgcctgacacagtgctagttacagttactgtactcaaatacttgttgagttgaatattattttgggactttggaggtgtttatgtgaaacaaagacattttctctttctataacaggcctgttttcctcaggtcttgctaagcctgtgacctgtcagctatgcttaggtgagtaaatagttccactggaaatgtttcactgatttctagaataattagaaagtgaaatggagaagagccttaaccacgtggtcagtctcccagtttcacaccttctctctaaaatggtgcaaaaagcttcctgtaatatattgtttgatgttttgttttatttgcttttaggtctcatgtctttctttctatcttagatcttgtgaaaaaataatctgtaatttatctgtaactaccttatagagaagatctctttaaagtaaagaacctctgaagccatttaattcccaagaacattaccaagagaaaccaccttgcctgtagaggaccattttatctaactcctctgtaaatactcaggacttagcttttcatttcatttctttcttttattaaaaatcttttctattgaagtataactcatacacagaaaagtatataaatcatatttgtacaatttgatgaatcattacaaagtgaatatactcacgtcaccagcacccaggtcaagaaatagaacattattatatgccacaactcctccttacaccctattgttatcactatatcctcctcactctctcaagttctgacatcatagattagtttttttatctttctccatagtgcctgacatagtgctagttggattagtttattagttttgttcattttgaactttatataaatgaaatcaaacagtgtgtattcttttggatctggtgttttttgctcaatactgttttcgtgacatccattcaggttgttgcttgtggctgtagttttttatttgtattttttgtgtgtgtgagacagagtcttgctctgtcacccaggttggagtgcagtggcatgatcacagctcactgcagccataacctcccaggaacaagcgatcttccaacctcagctttttgagtagctgggaccacaggcacatgccaccatgcctcatttttaattttttataggctcatttttaatttttttatagagacaggatctctctatgttgcccagactggtcttgaactcctggcctgaagcaatactcccacctcagtgtaccaaagtgatgggattacagatgtgaaccaccatgcccagccatttatttgtatttttgtatattatttcgttgctcgaatataccacagtctatttactctatttttaatgaatttgtggattgtttccagtctggggctattacggatgctgatgttgtgaatattattatacatgtcttttggttacatatgcttgaatttctattgcttgtatagatcagagttgctgggtcatggaggatgcatatttttgacattattgataatgacagtttttctaagtcattgtatcaatttacatgctcaccagcaatgtatgagaatttcagctgtttcacattcttactaacacttggtattgccagtctttttagccatagctgttctggtgggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcattacatcactaccacaatcttaattactggactttattattacctggtaaagcaactcctttcaccttgttcctcttatttaaaagtatcttggatattcttggccctttgcatttagaatcagcttgtcatgttccacaaaaaagaaacgtgctgagatttttattgggattgcattgcatctaaaaatcaatttagagggaactcaccattttatggtattcagttttccaatccatgaacatgcccagcagatttggtgtttggtgagtgccttcttcttgatccatagaatgacacactcttgctgtatcctcacgtggtggaagggataaatgcacttccttggacctattttataaggacattaatctcatttacaagggctctgccctcattatttaattgccccctaaaagcctcatcaaataccatcacattggtgatgatatttcaacatatgaattttggggggaacacaaacattcagaccatagcaaacctattttagacattttctcagcatcctttatgtctgttacatacttttctctgtattctatccttctttttctctctatacttcattctaggtattttcttttttttctttttttttttttgagacagttgcatctacatactttattttcaaaaaatcttcacaggaacaatgcaaggtagatattgccgtgtctctatttttacatgtggagaagcagacccagaggggttaaataactgtctgcaatcatatagctatttctggaactgtgttttaaataggaattttataaaccatatatagaacttgtatcaactggaccatttaaaatgtgcatggagaagtttctatttaaaggactcccatgaaaggtagattaattcaataagtagtattgggatttactgacttgccattttgggggtttaaaaaaaaagacaagtaaaactggatccttatctcacctcttataccaaaataaattccagatggaacaaagatttacatgtaaaacatgaagtcacagacatcctagaagaacacatggatgcatatttttagaatcttacattctggatattttcctgtgacttaacttccaattcattaattctgtcttcagctttgtctaaactccctttaaactcactcattgagttcttaatattatttgtcatgttttttatttttagaattttcatttggttctttttataagatagtgtttggttctcagccaaactctgccaaaatatcttttaacatactggccataattatttgaaaatcttcatttgattactcattatttcaatccttgagggtacgtttctattgtctattgtttgtcttaattttctatcactttacctttctcctggttagttttgattgaatggtagacattatatatgaaagattatagtagagatggtttgagacctcagttatttttatctttatctagaaaggatttatactcacttctggcacgtggttagagacactagcaatctcacatctccttaattcaatatgagactgagataatttaaagctgcccttcaatccaagtgaaggttgacttacccttccttttagtatttatgccttctaagttgaaacccaaagcttgggtttttttttccccttgggagttctccctctttgaagggtccttaattccaatttttgttcttgtagcttcatgagtctgtcagaagctcctctctctctctctctctctctctctctctcagctgactctactatatcagccaatgaccttaggagaaaaacagcctctctcagttttctttttatcctgcattttggctttatagtattgcattactttgttagatctcagatatcttcaaacatatatcatttatatcttgccccaattttcttgtgtttttttaagcaggaaatttagcccaaattacttttgcttccattactagaagcagaatcagcttatcatttcttcaacaaatgtttattgatcatctcctgtgtatcatgcactgtacaaaacaatggagatgcagctgttgaacagattagaggggattcctgccattgtggagcatacagacaagtgaacaggcacatataatacaatttcataaagcaatggtagggttaatcataggatgatgtagagcactaaggaggagtgcctgaccatgacttttgaaatcaaggaacatgttcttgacaaagcatcttctgagcttaaacctaaaaagtaagtaagaattatctaggataagactgttttaggcagtaggaacagcaagtgcaaaggcctggagatgaaagagaacatggtacatccaggaataagaaaacctagtttgtatgaagctactattatcaagacagggtggttctggcatgaggacaggcatatatatcaatggaacaggactgagaggtcaaaaataaactcttatatttataatcaattgatttttgacaaaagtaccaagatgattagttggggggaaaagataccctgttcaataaatgatgttgggaaaattggatatccacatgcaaaaaagatgaacttagatactcactagagaccataccccaaaaatgaactcaaaatggatcataggcttaaatgtaagtaccaaaacaataaaatgtttagaagaaaacatagaaaatccttaagatcttgcagagcaaagatttattagatatgacaccaaacacatagtctaaaaaagaaatgaaccgttttggaaagaaactttttttttttttcaaaagaaaaccttgaaaaatgaaaagaaatgcaacagactaggagaaaatctttggaaaacatatatctggtaaataacttatattcaaaggaatttacaaaggattcttggaatgtaataataagacaaaccaaacaaaaaaatgagcaaaagatatgaacagatattataccacaaatgaagatacacaaatggctaaataaatacatgaaaacatgttcgacatcattatccattacagaaatttaaattaaaaccacagtgagataccatttcacacccactagactggctataatgaaaaagacaataagaagtggagatgtggagaaatggaaactctcatacattgctagtggaaatgtaaaatgattcagctgttttgtaaaacagtttgtcagttcctcaataagttaacatagaattacaatatgacccagcatttccactcctaggcatatacctaagataattgaaaacgtatgttcacacaaaagcctctacattgaatgttcatagcagcattattcataatagtcaaaaagtaaaacagctccaatgtctgatgtggtataatgtgatataatattctatacaatgcaatatttttcagccattaaaaggaatgaattatgaataatgctacaacatggctgagcctcaaatatattatgctaagtgaaggaagttagtcacaaaaaaaccacattgtatgattccatttatatgaaatgtccagaataggcaaatatatagagacaaaaattagattactggatgcctggggcagggggtaggaattaggattaactgaatatgggcataagggcacttattggggatgaaaatattctaaaactgatttaccacagccagggttatagcagtggaacgaaataaaggaaatgatgcaagagatatcatgaagttacacaattctgtaaagttactagaaattattgaattgtacacttaaaatggatgaattctacagtatgtgaattatatctatataaagtagttttttttaagtgtctggcacatagaagatggtgaataaatgtgtaaggggcgttggttgtttctgaatgatacctatctttagaggaagagaatcttcaaggctattcgatttacttcagagatttctccctctaacagatgtgtccagggtcccagtgcagaatcaattgaattagaagcttcaaggatgggagtctagtcgtatataatttgacaaagccctatgggtgattttgccaagcactgcaaattgagactctgtgatttatggaattgtgaatggcttagtatggtcagaactcagggtgcatgtgggacccaataggtacttgcactagagtgggcagtaatcaagaatcttggcccagaatcatctctgtcttcctcgctttcccttttttcctctctacatccctctccctttctgcctccctgcctctctctctgcttcttactcttattctctctgatagaaatagctagctagctattcccagatcctacttagaatttttttcagaattgtagggttaaaatatatcatacagatcatccgtggcagtggttcttaaccagggatgcatattagtcttacctggagaactttttcaagatacacaggtccctggccacacccagacatacatcattagaatctttagagtgagaccatgggcatatatagtttataaaaaggtttttcaggtgatgctgatgctcatctccatttgagaacgtactgctctaaaggaagaaataaaagcataaagaagataagatttggttccccatgcctaacttcagcttccctgttacagattattaggtctgtatcacctgtgttactgaagctacttttgaagaccactagacctgagcttgggtggtagtgaatgcttaatgaacaccactgtggaataccatttggaaaatcaattcataaactctggggagagagggattagatttcagttgccatttcctcagccagatgatagtgctgtgtgcttggaatagccaagaaaggagggtggtttcctgtctcttgtggcttcctggtgacttctcttggtgctagctgctgaaaccactttaaaataataggctgttgagtaattttctccatgtatatccacctgtcagtgggcctgcacttcagagatgaagagtagtttttattggcgtgatggcatatagcagggattgaaaccaaacagccgcaatgaaattgattttcaaaaagaaattacttctgaattttattctgtggtttgtggattgttattcttacttcatcctgccacaccagtggcctacaaggacaatgaaagcttggacataagtaagagttttggatcaatccacaaggctctgtacctagaaaaattgcatgctgcgaaagcacttttgctatgtagtctaaatgttggggaaactctgagagtttcttctgtaaggatggaccttaacacctgccacaactagtcagactgagggaaagaagggcaaagagtagctttcaggagttctttcgactcaacccccactccattgagtccctatttggtatgagataatgctagtagggggattgtatcctcaagacagattcagctaacagaaccaatgaaggagcacaaacctacttcatccttaatgacattagacaaatcctttggtgcagcttgtttctgtttggattcccagctgacatctcaaatttagtaagctaaactgaacttatcttcattcttccccttcccaccacacacaccaaattttataaaagtaaaccctggtttcatgctctcaatcacttatgcataaaacttggaaggccttatatttttacttctcccttgtccttgctacctatatatagcaatcaattgttaagttgactcctactttgtgatgttgatttatattgttcatgatgtctcttgcatgactccctttctttctagtctcactgctatcactctggctgtatttggcttagatgatcttcaaggtgcctcccaacaatgaaaatctgtgactctttctcagctccttattacctcactcctacagtggttgtgtagctgagagttgctttgttctctgttccatatatatacctcagctagattatttttcttccagagttattttgttatgtcacttcctcctcagaaaccttgacatctccctactgcccgtagaataaagttcagacttcttaaactggcattctaagcccctttgcaattgggtttgaactactctgtcactcttctttttattctctgtttgaatcttgttttatccagactggtccactgacaggccgcgttctggcctttgtttgtttacctgttcccccgaagaagaatgttctttcctccaacctgtctcttggacccctccaggtccttcaaagctcaacttaaaccttaactcttgtgtgcattcttccttgcccatctatccatcccagcaccctaaattcctcattcagcactgtgctgtgttgtaggtgttcttgtttccttaacttgatgtgaaggtttttgaagacagagactgagtgttacattcctttatagctcttatacctacaacgctaactgtactcttttaattaaataccaaagtgaatcttaaggtattgaaacattccccctaatatcggactctaaaatatagttgtacacattgattgtgaggattatcatgctaccttaaggatctggtgattattaatggagtctgtcagtagggcttctttgcttttagagccctgcttaaggtcaagcaccctcacagaaagtttcttagactctagagcttccttcctcagttcctttccctccttcagatctttaaaagccttccacataacaagtattcatattccactttgacctgctgtatacctcttgatttcctcaatacagcaagtccttaccttcaaaatgctttcggaattcatttctccctgaatactgaaggtacctcaacttcttggctttcagattctaactcacgtgccaggtcacgagaggctccatacccaagtttcttttcaagtcacaaaccccatacacccccatcgtatatcaaagttccctaaccctcttgtttgtatttttaacagtaactcatttaaacgtgtaaatgtgggaaagcccttaaggtcaggactctctctgtttgtcttgtatagtgcaaaatatgccggtgttccaaataataaaggtttagggaaaagcccaggttgtggttatgtacgtgtctgtgtttgtctgtgtgagggagtcaaggaaggggagggggagaaaatggagggactgacttgtgtttctttgtgtttgcgtataagtattaaatgctagaattctagcatttaatttctaggagaaatgtgattcatagttcaggacataagaccaagtagtactactgtttcataaactacactcttacatttccagttaacccattttcttctcagcccctgactttacctattcattcagaaagtctggctcccacctgctaaaccagagtgcctcatgcttattttggtctgttttggatatctttcttatcctggaggttgtagaaagagtactggaataagttctggctcttaaccaactagcatatttcagtgtccttatttgtaaaatgggaaagacagtaccttccctgtctccttcgcactgtctttttgaggatcaaacacaaatatgtgtgaaaaatataaagtcttgtggttatttcttagaggactatttgataaatctgtctctttgtctcgttaattatgtaaaactttttttctaattactaccttatattttccatatagttgccctgtctgttgacataaattcacaggggttggtaatggtactgcattttttcaaatcgtgcttttatgttatactccctttttgcatttacaaatgctttctttcagcctggccctctgacaatttatttccacaagttgtagagggataactggattggaaattgggatacagtagtactggtcccaggtctgcgtttagttattctcttctagttaagttggttcaccttaggtaggtcatttcatctttctggctctctgtttacttatctgcaaaatgttggagattgaagttggtgatctataagttctcttcaaacactaacaatttatcattgcagctaaatagaattcctgatgctggccaggcacggtggctcacacctgtaatcccagcattttggaagactgaggtgggtggatcacctgaggtcaggagttcgagaccagcctgaccaacgtggtgaaaccccgtctctactaaaaatacaaaaatcaactgggtgtggtggcacgcacctgtaatcctagctacttgggaggctgaggcaggagaatcagcttgagcccaagaggtggaggttgcagtgagccaagatcgcaccactgcactccagcctgggtgacagagcgagactccgtgtcaaaaaaaaaaaaaaaaaagaattcctgatgcttttttttcagtttttcctgctccacaccccgctccttgagaatcactggcctaatgaatatagtccagatgccaaattcaagacctacatcagtgttggcttgccagtattatgtactgtttccaacaagaacccccggttatatatagattggttttcttactgcacattcctaccttcattgccactgtgtcattccccctgttaaaatcttttttttttctttttttttttgtggtagaatactcctttgtctctaaggacaagcttaaatgttatactttcctgtgaagcctttcctaatagcttaaaccttagtaatattttttctatttcatctgaaccacatctgcatttatgatatgccagacactatacctggcattgtaggagacagaaagataaaataagttcctcacattagagaaggctgaaattgggaattagcattctgggcagtggttagcagcatcagcaaagacttggaaatagtagagtggagtagagtagagggtgagtttggataaaggcttagagcccatggaccttacttatttggcctataactatatatcctcttatgacagttcttgtgatagtatgctaccttataatatgaaattgtggtttatttgtcatttattggctacctagctttcatttccttttcctaataccattgcagtttctttttggagtagtccctttccattattggatggtgtaataggaaatctaggtgcctgtatcccacaagagaagccaaaggggtcaagtccttctacttactaccccagtaaaatcaaagagcagtagccatgtgatgtatggtcaaccaacctacattctcttgtggggctggcttgactttttgtcttacagtctatatcctttggcccattgctccaatcaccctcttgcaattacctcaagtctcttgactctctgtccccaggtccccctgtcttaacaaaacctcagtctaggattagccctaccatttggctttatcagttctacatgaaagactgttgaataggactgcagagaataaccaattacagccactacaaattcaggccccaacctctgctggatacttagttacctagcaatctttctttctgtggactgaattagcttgatcttctgaactcagcagcaattctgtactctcactttggtcctcagacctcctgctctaagacatacttcactttcagctgttaaaacccaattcctacttcactgaaaacaatcaagactatctgtgacatcatctgcaaatccattcccctcactaactataataccacctatggattttactccatttgcccccactcttgtgctcctgtctccatagaggaaatgtgttcctttggttcaagaccagtccttttatctgagctttggatcttctccccgcttactatctcatggtcctttctcttagtcattttcttcctatcctgtatcttggatctctctcaaacttctttttttcctcttagcatgtagtcatgctcacatctcatctttgggggggaccttttttgacccaaatcttcctaaaactaccctttcctacttctgtaaatagttaagcttctgaaaagagtggaataaacttgctgtctttacgttttaaccactcattgatacctaatcctcctgtggttcagcttctgtgtcctcctcccaggagtttgtgcttgctcaccagtgaccttcatattgtaaaatttaacgggacacatttattctaatcatatttcacttatctgtcaagtcctttattttattatttaaaatttttgataataagcagagaaagccacttgacattatgaatttactggggatagttatttcaatgattaatgttcctcagtgaatatttattatgaagtttcaattttgttttagaattttgtaattgagatataatttacataacttaaaattcatccttttaaagtgtacaaaacactagtttttagtatattcacagagttgtgcaactgtgaccattgtctaatccaagaacattttcattgccccccaaagaaactgtatccattagcagtcattccccaattcctcctttcccccatcctctatcaaccactaatctactttctgccgctatggatttacctatgctggacatgtcatataaatggaatcatgtaatatgtggctttatgtgtctggccttcttcacttagcataatattttcaaaattcatccatgctggaacatgtatccgtcctttttcccttttacaggtgaataaaattccattgtatggatataccaccttttatttatctattttgtctattgatgaacatttgagttgtttccaccttggggtattatgaataatgctgctatgaacatggaggtgtacaggtttttgtttaaacacctgttttccattcatttggggtatatacctagtggtggaattgctgggtcctatgttaattctatgtttaacttattgaggaaccaccaagctgtttttcacaattgttgaaccatattacattgtcaccagcagtgtataagggttccagtttctccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtggaattgttctagattactccttctcacttcctccccactcacattctaacaccaaatcttttttttttttttttttttgacacagagtttcactctttcacccaggctggagtgcagtggcatcatctcggctcactgcaacctctgccttctggtttcaagcgattctcctgcctcagcctcctgagtagctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaaacataatccccaatgttggaggtggggcctggtggaaggtgtttgagtcatgggggcagatccctcattaatggcttgatgttgtccttaagatagtgagttctcatgaggtctggttgtttaaaagtgtgtggcacctcttctcctcttccttgctccctttctcaccatgtgatgtgcctactcccactccaccttccagcatgattttaagcttcctgaggcccttcccagaagccaagcagatgtaggtaccatgcttgtacagccagtagaactgtgagccaattaagcctctttttattagtaaatcacccagtctcacagtctcaggtattactttatagtaatagtaatgcaaaaatggcctaatacatctgtgcatgttatttaacttgtctaccttatctagtaaactgaagtccttctctactaaacccctctgctaaacccctttttgtatgactatgtccacaatgcctagaacaatgtcacgcacaccataggtgctcaaactggttcatggtttttttttttttttttgatgctcaaacttttgaaggaaagaattagaatgtgatactttattataaatccctaggcagaatacgttcaaggaaaccgtttcttcttgctactgtaactttttgttgtcatactttctatttattgagaggattatgtttttcttgggacctggacttatgtgaagtgaacaaaacaagattaattgtgctctgtctgtcagacatcccacctcactttctccatcatgctccagtggggtgtggcaaggttgtagcattgtcacaagtgggacaaggattggaagggcaggacaagcaaaattttcaaccgcaatttttttagcattgccctgggaaatcacacaatagtagagctgaaaagaatttcaagagactgtcttatccaggccctctgccttcaagcaagtgaattttaaagcattcatgacaaatggtcactcaggagcccctaataatctcactaagaagaatattcaatggagatgggaagaaatacaaaagtgcaaaagttatgtatgccaagtagtccacaggtatacttcaatatagagaaggatatattaggaaatgactccggtgcaaatctatatatagatctgtgttttctcattgccttttattaacaaatgggaagtgtcattccccagagaactgagcacgttatctggtgtggagtcaaaaaaaagaaggaattagagatcaaagaaggactctgaaattgttcctggaatctgggctaatggaatgagccagctgccttgggaaagacctgtatcagatagatgagttatgctgcttcaggctgtttaattaatgagattgggttctgtaactgacctgtggatatgaaatctgcagactgaggacagaacatactattgtgaagaaattttgcattctaagtggaggattgtggagtggtactctacatggcagttagatacatggacttcatagcctgaagtcaggatttgaatcccagccctgccatttactacaagtctcccactagtcttctccatttcttcgtctataataaagataatatcgactctataaagttgttatgagaatcaaagaggcaatggatatgaaccttatagcaatagtgcttggcatatagtaagtcctcactaaatgttaactactactactactactgcttagtagtagtagtgttctaatcattactgtgctgtactaaagagacaatgagcaagcaaagggggaaatgcttggttagtcttagcaggaaattcatggttatttggtggtggtggtggaggcaatgaaaaaaggttgccaatagtgtaaatgcctagagagccttctcatgggcacctgaattctgtcacatttccaatattagatgtttgctgattatatgagggctacacctatcatatagtatttcacttaaaaaatgtttccattggcttaatactttaggctctgctactccttgcaaagatcaatacaaatccccaaattacctgaaaagcctattttacattctctttcttaagaaatactgttgttgcccacccccataatattgacactttgccaatgaattatacaaaaaacaagaaaagaaataaacaatcacgttgtactagaggcagccagtatttccaaatgatgggtccatgacatacaagcaagagaagttcatgaatagttcagtacttagaatttgaatgttggctagattgggaaaactcatgtaacaggttttaaccccagtttgagggagttgttttaaaaagaacttcctaataatcatttacagtccagttagccattttcccatttgtagtaagggtttttatttagccttgctcatttaaaattggtcttcagtaatgcatttggggcttgataactgtgcaaatgattttctcaaatagcattgtgatgatgccaagagctctgaatgctttttatggcttcaccccaattctacaggaacatgaatgtgttgaataaaactttctctgggttagtctgagcagtaatttctagtttctgtaccgtaagcctatcatgtaggtaagatcgtaagctaaatagtcacagacctgctttattgttgtttatttcttattgtggtaaaatatatgtaatgtaaaatttatcattttagtcatttttaggtgtaccgttcagtggcattacgtacattcacaatgttgtgcaatgattgccactatctatttccagaatgtttttatccttccaaatggaaactctttctacccattaaccaactccctactctcccctccccccagcccctatcaaccattaatctaactttttttctgtgaatttggctactctaaatacctcatgtaagtggagtcatacactatttgtcctttcatgactggcttacttaaattagctaaggttcacttatgttgtagcatgtatcagaattttattcctattatggctgaatgatactccattgtatgtatataccacattttgtttatccatttatctgtggatggacacttgggttgcttccaccttggggtattgtgaataatgctgctatgaacatgggtgtacacattttcatttgaacacctgttttcaattcatttagggtacatactaaggagtaggattgctgagttgtatggtaattctacatttaacttactgaggaaccaccaaactgttttccataatttttgaataattttcgcatttttaccagaggtgtatgagggttccaaatttctccacatccttatcaacacttgttattatatttttgattatacccatcctattgtatgtaaagtggtatttaattattgttttgattggcattgccctaaaaactaatgatattgagcatctttccatatgcttattggttatttgcatatctttggagaaatgtccattaaagtcctttgtccattttttaatcaggttatttttgttgttgttgagttgtaggagttttttaaatatattctagatattaacctcttatccatatatgtgatttgcaaatattttctcccattttgtggattaccttttcactttgttgttaatatcttttgatgcacaaaattttaaatattaatgtagtccaatttatctattttttgtgtatgtgcttttggtatcatatcaagaaatcttgaaaaatccaatttcatgaagtttttctcctatattttcttctaagaattttatagttgtaggtcttttgtttaggcctttgaaccattttgagttaatttttgtatatggtataagataaaggttcagtttcactcttttatacgtagatatccagttttcctaatgccatttgttgagaagactgtcctttctcaactgaatggtcttggtatccttgttgaaaatcaattgatcatatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcatttttataatttgcagtggcaaattataaaacgcaatagcaattatgctatttgtagtttgttacatttggcaagatatgtggtggggtgagtggttgggagagatgtgagggtgtgtatgtgtgtgtgcatatatacatatataatttgtgtatatacatacacacatgaaaatagtgggaaacacccaagtcagtaaaatggacaaacacattgaggaaaatggctttaaaggtttctaacaaaaataatgtaattcttgtgctaagtattagactagtatatttcactctacttctaagccatgccagtcatttttataaactcatactgttgtttgcaacataataaaggcagaaaatgcagttggttcatcaaagtcactccctttgtcataactttatatggagggatattacactattggtgccaactttatagaaggacaggctgttgcttggatgtttgcatgtatatgtataatggtgcagcaagaattatgttaggactctcatgggtacattctatttagactatgagaagacaagagctcggattatagagctaaactgcatggctttgaattgttgttctcacagtagctttgtgaccttgaataaactacatagggaaactgaggctcacagttgatgtgaaaagtggaaaaaataacaagctgtgtaattcatagggtggttatgagaataaaatacttgcgaagtatttagaaaagttcctggcttacagaaagtgttcaataagtgttagctgctgtgtttgttattgttgattactgttgttatttttactgccagaaataatagtagtagtagttggaggaggaggaggaagaggaggaggaggaggattataggtgtgtcacagactgaaaatgagtggggaggcaatgtcctatagtgcaaaattttagctttagaggctgaaaggcctgggtttgattactgcttttattatttatcagctgtgtgacttaaaacttaacctagttgttctttcatgagtaaagtgaataaaataatatacgaatgattacatttcagtattattgtgaagaccacattgaagtcacatatataaaaatacttgataagctgaaatactatacgttatatgtgtatattgctatttgccaactctcttaaaaagaaccaaaaagagttggcaaatagcaacatacacacatagcgtatttatatgttttattcttataaagaaccaaggagaattgaaaatgacttataaaaatgacaaaacatttatattgtcaaaattggtataatatgaagataaacccagagtagaaagctttgaattattattatatcatttattattttctttgtgctatgatatacactgtaaaaatcttgcctcatttactcctttcaacacctctttaggtctaaggcaggaacttgatttaattcaagttttgaaatattactatagcttcaatgtaaatacctcacagaaaacaaaacaaaacaaagcaaaactgaagttcagagaggttaacttgcctgtgttcacaaagccagtaagccagtaagctacatagccaggactggaatctagccctgatttcaaagcctcttaactgaacttgaaagatggcagtgggaggtgaaaagattttgagaaaatactataagggatgagtggaagctagacattattgaagatactctaaataaatgttgtttcttctcctattttcgaccttagtaaaaatgttcttaaggaaaatctaaacctagtcaataacctgagggagccaaggaatgtaatataagcccaatgagagcaaagactatttcttctttaccactgtattccctgtgactagaacagtgcctagcatatagcaggccctcaacaaataattattacttttatgtataaaatacatcaaaacatatatggtaaaaaaaaaagacctagtcatatttttagattctttttacttagagttctttttttttcttctcttcaacttttattttaaatttagggggacatgtgcaggatgtgcagatttgttacatgggtaaacatgtgccacggtggtttgctgcacagatcatcccatcacctaggtattaagcccagcatccattagctattcttcctgatgctctgacaactctagtaagagttgtttgtttgtttatttttttcttgtaaatttgtttaatttccttgtagactctggatattagacctttgtcagatggatagcttgccaacatttttatcccattctgtaggttgtctgttcactctgttgatcctttcttttgccatgccgaagctcttcagtttaattagatcccatttgtcaatttttgcttttgttgcaattgcttttggcattttagtcatgaaatctttgcccatttctatgtcctgaatgatattgcccagattttcttttagggtttttatagttttgggttttacatttaagtctttaatccatcctgagttattttttgtatatggtgtatggaaggtgtccaatttcaattttctgcatatggctagccagttctcccagcaccatttattaaatagggaatcgtttccccattgcttgtttttgtcaggtttgttgaaaatcagatggttgtaggtgtgcagtcttatttctgagttctctattctgttccattggtctatgtgtctgttcttgtactggtaccatgctgttactgtaatcttgtagtatagtttgaagttggatagcatgaggcctccagctttgttctttttgcttaggattgtcttggctatttgggctcttttttggttctatataaattttaaaatagttttttttttctaattttgtgaagaatgtcaatggtagtttaatgagagtagtgttgaatctataaattactttgtgcagtatggccattttcaagatattgattcttcctatccatgagcatggaatgtttctccatttctttgtgtcctctctgatttccttgagcagtggtctgtagttcttcttgaagaggtccctcacttcccttgttagctgtattcctaggtgtcttattcattttgtagcaattgtgaatgggaattaattcatgatttggctctctgcttgcctgttgttggtgtatagcaatgctagcaatttttgcacattgattctatatcttgagactttgctgaagttgtttatcagcttaagagcttaaggagcttttgggccgagatgatggggttttctagatataggatcatgtcatctgcaaacaaagataatttgacttcctctcttcctatttgaatacctttatttccttctcttgcctgattgccctggacagagcttccaatactatgttgaataggagtggtaagagggggtatccttgtcttgtgccagttttcaaggggaatgcttctagcttttgcccattcagtatactattggctgtgggtttgtcataaatggctgttattattttgaggtatgtttcttcaatatctggtttattgagagattttaacgtgaagggatgttgaattttattgaaggccttttctgcatctattgagataatcttgtggtttttgtctttagttctgtatatgtgatgagtcacgtttattgatttgtgtacgttgaaccaacgttgtaacctggggatgaagctgacttgatcatggtggatgaactttttgatgtgctactgtattttattgaggatttttgcattgatgttcaccaaggatattggcctaacgttttcttttttttgttgtatctctgccaggatttggtatcaggatgatgctgacctcataaaatgagttcaggaggagtccctccttttcaattgtttggaatagtttcagtagaaacagtaccaactcttctttgtacctctggtagaattcagctgtgaacctgtgtggtcctgggctttttggttggtaggctctttgtcaaagtcttaatttcagaactcattattggtctattcaaggattcaatttcttcctggttcagtcttgggagggtgtatgtgaccagaaatttatcgaattttttctggattttctagtttatgttcatagaggtgtttatagtattctttgatggttgtttgtatttctgtggggtcagtggtgatatccctcttatttctgattgtgtttagagtgtttcaaggttttttcatgtctctatctccttcacttcagctctgatctttgttatttcttgtcctctgctagctttggaatttggttgctcttagttctctagttcttttatatatatgtgtgtgtgtatatatatatatgtgtgtgtatatatatatatgtataaaatacttgaagttctagggtacatgtgcacaatgtgcacgtttgttacatatgtatacatgtgccatgttggtgtgcctcacccattaactcgaacctgatgtaaatgacgagttctctagttcttttagttgagatgttaggttgctaactttagatctttctagatttctgatgtgggcatttagtggtataaatttccctcttaacactgcttgagctgcatcgcagagattctggtacgttgtctctttgttctcattagtttcaaagaacttcttgatttctgccttaatttcactatttactcaacagtcattcaggagcatattgttcaatttacacgcagttttgtggttttgagtgaatttcttaatcttgagtactaatttgattgtgctgtggtctgaaagactgttatgatttcagttcttttgcatttgttgaggggtattttactgccaattatatgatcaattttagagtaactgccatgtgatgatgagaagaatgtattatgttgttttgaggtggagagttctatagatatcaggtccacttgatctagagctgagttcaggtagtaaatatctttgttaattttctatcttgatgatctgtctaatattgccagtggggtgttaaagtttcccactattattgtttgagagtctaagtctctttgtaggtctctaagaatttgccttatgaatctgggtgcttctgtattagttgtatgtatatttaggatagttagctcctcttgttgaattgaaccctttaccattgtgtaatgcccttttttgtcttttttgatctttgttgatttaaagtctgttttgtcagaaaataggattgcaacccctgcttttttctgttttccatttgcttgtaaattttccttcatccctttattttgagcctatgtgtgtctttgcacatgagatgggtcacttgaagacagcaataccaatgggtcttggctctttatccagtttgccattctgtgtgtcttttaattgagtcatttagcccatttacatttaagattagcatgtgtgagtttgttagttatatgtgagtttgatcctgtcatcttgatgatagctggttattttgtagacttgtttatgtggttgcttcatagtgtcactggtttgtgtacttcagtgtgttttgtagtggccagtaacagtttttcctttccatatttagtgcttccttcaggagcttttgaaaggcaggtctggtggtaatgaattccagctttttcttgtctgaagaggatcttatttctccttcacttacgaagcttagtttggccagatataattttctgggttggaatttcttttctttaagtacgttgaatattgtcccccagtctcttctggcttgtagggtttctgctgagaggtctgctattagtctgatggttttcactttgtcagtgacctgacctttctctctggttgcccttaacattttttcttttatttcaaccttgcagaatctgatgattatgtgtcttggggttgatcttctcatggagtatcttactggggttctctgcatttcctgaatttgaatgttggcctgtcttgctattttgggaacattctcctggatgatttcctgaactatgttttccagcttggttccattctccctgtctcttttaggttccccagtcgtaggttcagtttctttacataatcccatatttcatggaggttttgttcattcctttcattttttttctctattcttgtctgcctgtcttatttcagaaagatagtcttgaagcactgagattttttcctcctcttggtatattctgttattgctacttgtgattgcattgtgaagttctcgtgttgtgtttttcagctccatcaggttggctgtgttcctctctaaactggctcttctggctatcagctcctgtattgttttatcatgattcttcgcttctttgcactgggttacaacatgctcctttagctcagcaaagtttattattatccaccttctgaagcccacttccatctattcagccatctcagcctcagcccagttctgtgcctttgctggagaggtgttgcagtcatttggagaagaggcactctgactttttgagttttcagcatttttacgttgattctttcttatctttgtgggcttctcttcctttgatctttgaggttactgacctttgaattagatttttgtggggttttttgttgatgttgttattgttgttgttttctgtttgttttccttttaacagtcaggccactgtaccgtaggactgctgtggtttgctggtggtccactccagactccagttgcctcggtttctccagtaccttgagttatcaccagtgaaggccatgaaacagcaaacatgacagccagctccttcctctggaagctctgtcccaggggggtactgacctgttgccagcccacatgtgcctgtaggaaggagctagagacccccattgtgaggtcttagtcaggaagaatgggatcagaagcccaccgaaagaagcagtctggctgctttttggtagagcaggtgtgttgtatttcggggggacccttccttgtccaaaccacctgtattcttaacagccagcaggctggagtggctgagtcaaccaaacctcagagatggaggccaccctttcccccaggagatccgtcccagggagagatcagagctctatccgtagaaccctggctgcagtggctgaagccgccactgggagatcctgcccagtgaggaggaatggatcagggtcccacttaaagaagtagtctggcactgatctggcaaggcagctgtgctgcgctgtggggaacccttccccatccaggccatctgtattctccaaagttggcaggttggaatggctgagtctacggatcagcagagatggtggccgcccctccccacaggagttcagtcctgtctcaggcagactccagcctgttgcctttggctggcttgaattccaagccagtgcatcttaatgtgtgaggtgctgtggaagtggggcccacagaactgcttggctccctggaatcaccccccttcctagggacatgtatggatggacttgccagtgatcctgggtctggagtatgcattataaaactcttgggtttctgtgtgtgcctgagtggctgctctgctgagactccacacagctctgtgtattggacccaaggtcctggtggtgtggggtcacaaggtgatctcctgatccatgggttgcatagatctgtgggagaaacgtggtttcctggggcagggtcacacaatcactcacagcttcccttggctgggggtggagggttcctttggctgcatgtcactcccgggtgggccgtcatccctctctacttttcttcattctctgtaggtcaagttgtttgcctagtcagtcccaatgggagaacctggatatttcagttgaaggtgctgaattcactcacccctttcattcctctccattagtgctgcagactgaagctgcttctaatcgaccatcttggcccctcccatatttttagattcttatgaaatagagtgttagctaatgcatattaggtagttcctgaaatggtttcagtgaattatgtgtgcatataaatgtgaagcatctaaatgataggttggtctatttagtccagttgccggtgtcaataggagaatggtaactctattaatttgtgtaaacagtgcaattgtggtgactatctggggattagatactgggaacctattgactgacaaatgtataaggtagggctattatttctttactttttttggcttatagcaagcttcccagtagaataatattaaatgctataaaataagcaaagtgaatactcaaacctatttcctttgtacccttgtagtatgtgaaatacagtctttttttttttttttgagacagggtctcactctgtcacccaggctggagtgcagtggcgtgatctcagctcactgcaacctccgcctgccaggttcaagcgattctcctgtctcagcctccagagtagctgggattgcaggcatgccccaccaaggctggccactttttatatttttagtggagatggggtttcaccatgttggccaggctggtcttgaactcctgacctcaggtgatctgcctacctcggcctcccaaagtgctgggattacaggcatgagccaccacacccagccaatacagtcttttttgagggtaaggaaagaggtagtacttatctcagggaaattctttaaaccaaagagttggaactgtggctgccacatctttatgggaaatgtggcttaatgatttattatactatttgtgttcatacaacaaagagcactccctgtttgctgaggtagtatagtacaagaacattggatttggagtaagaagactttggttctactacttactgtgtgactttgagcaaaccattgactccctctatggaataataacatcttccgtctctcataggatactaggaatgtcaaaaggaagtcataggtgtttgttcactcattcctttcaaagatacttattgagttgctactttatgccacgtatggtatattagatattggatatattatagcggcaaacaaaacagatagtgtctctgaccctgatgtaattcatagtctaatggcagagccagcaaatatataagtaaatatgtacttacaaagggctatgaatggtggttaccagaggctgggaagggtcgtagggagaggggtcacgaagaggggttggttaatggataccaacatatagttagatataaggaataagttctagtgtttgatagcacaatagagtgactatcattaacaataattgattgtatatttcaaaaaggctagaagacaagatttgcaatgttctcaacacaaagaaatgataaatgtttgaggtgatgaatatcttaattacccatatccaaccattacacactgtatgcttgtatcaaaatatcacatgtactccaaaaatataatatgtacaactattatgtatccattaaattaaaaaagaaaccaaagggctatgaagagtgctgtgagagaataataggggagggtctgctttaattagaatgaacagagaaggttttgctgagtaggtagcattgttactgagacataggatgagaggggcgttgggaggggggcacataccaggtgatggaaaagcctatgtgaaagtcttgaagcaaggaagagcgtgggatgttggaggaactagaaaaagagcactgtgactggaaagtagttagtaagggggaaagttaggcaagatgagattgtaaaggcagggggatccatggcttcttcaccaaagttcgcagtagagtttggattctgttctaagtgaaaagtcctaaaacaggaaagagtttggcatgttcaaggtacaaaaggatgccagtgtgactagagcctagtatgagtagagggcatgttggtgggacaagaagtttgaattttgacctaagtaaaatgggaagacattggagggttttaagattttatagaaacaattagtgcagatgtagatttttgaagaagattcctctagctgatgtgtggaaaagggagaatcaagaagtgaaactagaatagttggatgttctttctttccaggtaaagaaggtgatggcattggactaatgtggtagtagtgaaggggaaatgatgtaaaggggttcaaggtatatcttgaacatacagctgagagaacaagctttctggtattggtatccaggtatataatctatctactgatgtgggggaaatttgggggggtcagtttttgagactagggaggtgtagaaatcaagactttagttttgatgaagtttgcttctgagaagtttaataaaatgaggagcaaatagtatccatttgtttatttttacagcttggaatgcattgatcttttataagagcagtttcagtggcatggtaggatggaacagtttaagataggagatactggagtttaaatgcctgaggataatctatagagtagagattgctgatgcaggagagagatgcaataaacaaaaatataaagtctttgaaaggggttgggagaagaaatgggatatagagcacaaatggaagatttggcctttgagagggacaggagcagttcatccactctaacaggaggaaagaagaggagaaaatgtgtgtaggtggagatcacctgatgaatttggtggtgggaagtgaggtgtgcccacctctgatgatacccttctcaattaagtatggggcaagatcgtcagggcagagagcagaggagagtgatgaaagttttgaagagagaaaatagttgtcctggaaagcaggcttgataaagttgtagatttcaaacaagcagcatttagtacctgtttgagatctgtgattatgagtttaagtacaacctgtcaccgagattgtgtgattgcttctagcaacatttagctgctcaggtgcaaattcagagcagtcaaatgactgaatttatccagggtcaaggacttgccaggctagggcaagcaagttgaggaagtgattacaatggcaaaccactgaaaatcctgcataaggagggaagaggttgacagatagtgacaaagtggcaagcttaatagattggagtcttgatgaagttcatttactcatttaacaaagaatttgaaagatagaaattataatactcggtattgactggggataagggaaaattagaaacggtaaagggatcattagggacatgtttttggcacagattaaaaaaagggattctaaatttctcaatatatttcatatctgactacacaatctttcatcttacacttttagtagatttctagcttaaatactcccaacagaaagtagctttactgttaaacaaattcaccattcttgtctttgacctttaacctgtggcctccgtggaagtggtccaggaaataatcttagaattaattgcttaaactttccaactatcttgttgagttactgccagtccataaatatcttaagaaataaaaaagatatagtgcttaaaatgtgtatgaaagtgttagagaatattatattgctataatcatagaagcagctttcatttcatatgatttattattaagaacaaagtccagtaccatgctgttttgcttactgtagccttgtagtatagtttgaagtcaggtagtgtgatgcctccagctttgttcttttggcttaggattgacttggcaatgtgggctcttttttggttccatatgaactttaaagtagttttttccaatctgtaaagaaagtcattggtaacttgatggggatggcattgaatctataaattaccttgggcagtatggccattttcacaatattgattctacctacccatgagcatggaatgttcttccatttgtttgtatcctcttttatttcattgagcagtggctggtagttctccttgaagaggtccttcacatcccttgtaagttggattcctaggtattttattctcttggaagcaattgtgaatgggagttcactcatgatttggctctgtttgtctgttattggtatataagaatgcttgtgattttcgtacattgattttgtatcctgagactttgctgaagttgcttatcagcttgaggagattttgggctgagaagatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctatcttgtgcccgttttcaaagggaatgcttccagtttttgcccattcagtatgataatggctgtgggtttggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacacctgaagcaatggcaacaaaagtcaaaattgaaaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatttacaagaaaaaaacaaacaaatccatcaaaaagtgggcaaaggatatgaacagacacttctcaaaagaagacatttatgcagccaaaaaacacatgaaaaaatgctcatcatcactggccatcagagaaatgcaaatcaaaaccaccatgagataccatctcacaccagttagagtggcgatcattaaaaagtcaggaaacaacaggtgctggagaggatgtggagaaataggaacacttttacactgttggtaggactgtaaactagttcaaccattgtggaagtcagtgtggcgattcctcagggatctagaactagaaataccatttgaaccagccatcccattactgggtatatacccaaaggattataaatcatgctgctataaagacacatgcacacatatgtttatagcggcactattcacaatagcaaagacttggaaccaacctaaatgtccaacaacgatagactggattaaggaaatgtggcacatatacaccatggaatactatgcagccataaaaaatgatgagttcatgtcctttgtagggacatggatgaaactggaaaccatcattctcagcaaaccatcgcaaggacaaaaaaccaaacactgcatgttctcactcataggtgggaattgaacaatgagaacacatggacacaggaaggggaacatcacacaccggggactgttgtggggtggggggaggggggaaggatagcattaggagatatacctaatgctaaatgatgagttaatgggtgcagcacaccaacatggcacatgtatacatgtgtaacaaacctgcacattgtgcacatgtaccctaaaacttgaagtataataacaatacaattaaaaaaaaaacaaaaaaaagaacaaagtccatccttgattttggataacactctcaggtataaacgtattttctcatttcacttaacaaatgttcataaacttctgctatgtgctaggctaaatgctagagatagaatagaaaataaaacaataggctgggcgcggtggctcacgcctggaatcccagcactttgggaggccgagttgggcagatcacctgaggtcgggagttcgagaccagcctggccaacatggagaaaccccgtctctactaaaaatacaaaattagcctggcatgtggtgcatgcctgtaatcccagctactcgggaggctgaggcaggagaattgcttgaactgggaggcagaggttggcggtgagccgagatcacaccattgcactctagcctgggcaacgagggaaactccatctcaaaaacaaacaagcaatcaaaaagacagtaaaggtccctcccctcaggaatcttacattcctatgcggagaccttatgattgtgtccagaaggtatcattaccttcttttacagatgacaaaagtgaagctcagattactcaagtcaaactagaagctaggtcttcagatcctcagttttgtctgtcttctgtaatgcattgtttcctttttagcatgataatacctacctttagtgatcatttttggataaatctgaaggatttggaccacatattttccccatgtgtctgaattcattccagttgtatatgtggtggagggggactatcttgagaaagttctccactattatttacatcattagaatctatatatatatatatatatatatattgcactttgtgatttaaattatgctgcaataggtaaggagggtgagagggagacaaacctcacaacaaaatacctgttcccctgtcccattattcatgtctccgttactcattctgtcctaggagctcattctgtctctccatctcactgtcacttaggtgataatctactccattatccactgatctccttgcccaccatctaacctactgccaatttaggcaaaattacccttgtctttccctcctaatttctcaagctcaccatttgtcagatatatgccttgtctgtgcctctcaggtaactcagtatttgaggaaatctaggtctacagctgacctcacaaattccacctgtgcagtactgtgtgcacatcaagtgttcaaatgctatttcctgactaaaacctatattgaggcatttttgagcctttcacaatgctccttagtcctattaatctaatcttcagaaatctctgtcacatacttttctattactactgccagcactctaagtcagaccacctgcaatgcatataccatcaactccttttctctccctcacttctttttattcacttggcaaagtcaaaatcacaattctaataacattctgcctccttggtgcttttacccatgcaataaaagtggctggaaaaaaacagatgactacactgcctgatctcactttatgtatatatgtatgtatgtatgcatgcatttatgtattttagattcaggggggacatgtgcagttttcttatataggtatattgcaggatgctgaggcctggggtatgatttatcccatcacttaggtagcgagcatagtactcaatagtttttcaacccctgcgctcctccctcccccagcattcagtagtccccagtgtctattgtggccatctttagttccatgtgtacccaatgtttcactgtcactacaagtgagaacacgtggtatttggttttctgttcctgcattagtttgcttaggataatggcctccaactgcatccatgttgttgcaaaaggcatgatttcattcttttttatggctacatagtattccgtggtgtataggtaccacattttctttacccaatccactgttgatgggcacctgggttgagtccatgtcttagctattgtgaatagtgctgcaatgaatatatgtgtgcatttgtctttttggtagaatgatttatttttctttgggtatatacccagtaataagattgctgggttgaatggtaattctattttgatttctttgagaagtcttctaactgcatttcacaggggctgaactaatttgcattcccaccaacagtgtataagtgttcacttttctctgcaatctcaccaacatgtttgtttgcttactttataataaaagctattccgattggtgtgagatgataccttattgtggatttgatttgcatttttctggtgattagtgatgttgagcattttttcatgtttattggctacttcttttgagaagtgtctgttcatgtcctttgcccactttttaatggagttacttgttttcttttcttaaattccttatggattctagatattagtcttttgttggatgcatattttgcagatattttctctcattctgtaggttgtctgtttactctgttggtagtttctttcactgtgcagaagctcttttgtttaagtctcatgtgtctatttttcattttgttgcatttgctgttgggatcttcatcataaattccttgcctaggccaatgtctagaagagtatttcctaggttttcttctaggattttatagtgggacatcttacatttaagtctttaagccatcttgatttaatttttgtacatggtgaaaggtagggagtcaagtttcattcttctgcatatggttagccagttgtcccagcaccatttattgaatagggtatcctttctctcctgtttacttttgtcaactttgtcaaagatcagttggttgtaggtatgcagcttcatttcaggggtctctattctgttccattggcctgtgggtctgtttttgtaccatgctgttttggttactgtagctttgtagtacagttttaagtcaggtaatgtgatgcctctagctttctttttgcttaggattgccttggctattcaagctgttttttggttccatatgaagctttgaatagctttttttctaattctgtgaaaaatgatattggtaatttgataggaatagcattgactctgtagattgctttgggcactgtggacattttaacaatattgattcttctagcccatgagcatggaatgcttttttgtttgcttgtgtcatctctgaattcctttagtagtattttgtaggtctcctcatagagatattttaccttcttggttagctgtactcctaggtatttgtgtgtgtgtgtgtgtgtgtgtgtgtgtgtgtgtgtgtattgtaaatggaattgcattcttgatttggctctcagcttgaacattattagtgtgtggaaatgctactgatctttgtgcattgattttgtatcctgagactttgctgaggtcttatcagatctaggagtcttttggcagaatctttagagttttctaggtattgaatcatattgtcagcaacaagagataatttgacttactctttttctattgggatgccttttatttctttctctcactttgaattcatgaatgtagaactcaagttagacctttatgcagcctttctagttcattcattcccttcctttttaagattttgtcatactttcttctcaaactctcaacatcactgcccacatgctcactttcaacagagaactctgcttcctatgtttgcatggtactaaagagtttacaaagtacttttgcatgccttttctgattctatctctccctcttctgcccttggaaattgctagtttaagcagtattcttctttagagcaaataactcttggttcttcagttgattctagtatctagtttacctctcctaaccatttaagctgcgcagatcaacctgtgcttgcatttcgcagtctgtaaaaggaggatccttacacctaccattttcacttacaggaacattgtataagcatttgtctttactctgattctttttaagtcttcgactacaaagaaactgattttccatccacacccacagcaatacaaaagataacctccctggactggagattcagtgattattttttgactccaaagtgtctgatctgcagtttgataatcaagaaaaatccatttttatcgtggcctagactagcttctagtctaaatattagtgtgctctgttttaatatttctccatgtattaaatcagagttttcagagcaaataaaataaggatgagctttaattttctaaaagtatttctttactaaaggattccttttgggttgaacaggttcttggtagattttaaatgagttgactgatacaaattcagtttatactacatttcgggaacatccttttgttaacaatgagctacatttgtacaggcagtccccaattttcaccacagtggtattcctgggaactgttataaaacagatcatattttcctacaggaacaatattactattggggtttgtgttcctgaccaaagatgtagcatcaaataaatcataaatataatcaacaatgtgacatgaaagcaaagatataggaactagaaatctataatcattttaagtagttaaaaattacactccaaatcctacaaaatggacacaaatatggcatatgcaatcattacacaaatgacaccaatgcattagaaagtgtgcgtaatgcccttaaaatgcaacccaattttacagtaaattttaccaaaaataacctgctagtcacaagggatctatttgtagtaataaattctttctttttgctatcttgtaatacaaaaattcttgtggtgttggaggcagtgtatggtctaaatgatctgactttgttcccaaacctggcagtgcatcagtcacctgatgagctttaaagatgcaggtttctgggcctgaaccccagagaatgtcattgaataggactgtggggaggccaggaatgtgtatttttaaaagttccctaggcgattctgacgcacagccaagtttagaatcctaggcatggatgtgtcagtacctatttatctttcccatccctttttttcagcaagctcatacattcagaatcattccaccgaccataacatttgtgctggtaataggtttaatacgtgtttccaaggtgtttctttcattgaaaaacattttaaaaagtaaaggctgtcttgaagtttgaaaaacattttagtaagtgaggatgaagtccacatttctctactcacccactcctatatgtagctttgaataggcttaggtattaaatcatgtcttaggaagtgacagtttttttgacagccatcagagttctttgtagttgattgggaatcaagaagaattgctaggtcattaatccctagtattttttttaattttaaaaaatttattctttttttattatactttaagttctagggtacatgtgcacaatgtgcaggtttgttacatatgtatacatgtgccatgttggtgtgctgcacccattaactcgtcatttacattaggtatatctcctaatgctatccctccccactccccccaccccacaacaggccccggtgtgtgatgttccccaccctgtgtccaagtgttctcattgttcaattcccacctatgagtgagtacatgtggtgtttggttttctgtcattgcgatagtttgctgagaatgatggtttccagcttcatccatgtccctacaaagggcaggaactcatccttttttatggctgcatagtattccacggtgtatatgtgccacattttcttaatctagtctatcattggtggacatttgtgttggttccaagtctttgctattgtgaatagtgccgcaataaacatacgtgtgcatgtgtctttatagcagcatgatttataatcctttgggtatatacctatccagtaatgggatggctgggtcaaatggtatttctagttctagatccttgaggaatcgccacactgtcttccacaatggttgaactagtttacagtcccaccaacagtgtaaaagtgttcctatttttccacatcctctccagcacctgttgtttcctgactttttaatgatcgccactctaactggtgtgagatggtatctcatggtggttttgatttgcatttctctgatggccagtgatgatgagcattttttcatgtgttttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaagatttgagtctttaatccatttagaattaatttttgtatatggtgtaaggaagggatccagttttagctttctatatatggctagccagttctcccagcaccatttattgaatagggaatcctttacccatttcttgtttttgtcaggtttgtcaaagatcagatggttgtagatgtgtggtattatttctgagggctctgttctgttcccttggtctatatctctgttttggtaccagtaccatgctgttttggttactgtagccttgtagtatagtttgaagtcaggtagtgtgatgcctccagctttgttcttttggcttaggattaatcactagtattttttaaaaaatacatttcattgtgtatatttaaggtatacaacataatgttatgggatacatatacatagtaaaaagataattacagtgaaacaaactaatgtatccatcatctcacatagttacctatttttttgtttctgtagcaagagcagctaaaatttacttatttagcatgaatcccaaatacagtacaattttattacatatactcctcatgttgtacattagatctctagacttgtttatcctatatatctgctatttgttatcctctgacctacatacatctctccattttctccctcaagcccccacccatagtaatcactgttgtgttctctatcttcatatgtttgaatttttaagattctgcatataagtgatgtcatgtgatatggtttggctgtgtccccacccaaatctcatcttgaattgtagctcccataattcccacatatcatgggaggaacctggtggaaggcaattgaattgtggtggaggtctttcctgtgctgttctcatgatagtgagttctcatgagatctgatggttttataaaggggagttcccctgcacatgccttctcttgcctgctgcaatgtaagatgtgtcttgcttctccttcaccatctgccatgattgtgaggcctcccagccatgtgaaactgtgagtccattaaacctctttcctttataaattacccagtctcagatatgtctttattagcagcgtgaaaacagactaatacagtaaattggcaccgaggtagtgggacattgctgtaaagatacccaaaaatgtggaagcgtctttagaactgggtatcaggcagaggttggaacagtttagagcactcagaagaagtcaggaaaatatgggaaagtttggaacttcctagagacttgttgaatggctttaaccaaaatgctgatagtgatatggacaaaaaaagttcaggctgaagtggtctcagatggagatgaggaacttgttgggaactggagcaaagatgactcttgctatgttttaacacagagactgatggcatattgcccctgccctagagatgtgtggaactttgaacttgagaaaattctaggaagaaatttctaagcagtaaagcattcaagaagtgacttggatactgttaaaagcattcagttttatgtattcacaaagatatggtttggaattggaacttatgtttaaaagggaagcagagcataaaagtttggaaaatttgtagctggatgatgcgacagaaaataaaaacccattttctgaggagaaattcaagctggctgcagaaatttacataagtaatgaggagccaaatgttaattgccaagacaataggggaaatgtctccagggtatgtcagaggtttccacggcagcccctgccctcacaagcccaaggcataagaggaaaaattggtttcgtgagcctgggtccagggatccccctgctgtatgtgcagcccagggacttggtgtcctgtgtcccagctgcttcagctgtggctaaaaggggccaaggtacaactcggcctgtgacttcagagggtgcaagccccaatttttggcagcttccatgtggtattgagcctgcggatgcacagaagtcaagaattgaagtttggaggcctctgcctagatttcagaggatgtatggaaatgcctggatgtccaggcaaagattgctgcagcagtggggccttcatggagaacctctgctagggcagtgcagaagggaaatgtggggtgcaagccctcagccagaatccttactggggcactgcctggtggagctatgagaaggccactgtcctccagaccccagaattgtagatctactgacagcttgtactgtgtacctagaaaagccacagacactcaacgccaccctgttaaagcagccaggagggggctgtaccctgcaaagccacaggggtggagctgcccaaggccatgggagcccacctcttgcatcagcgttacctggatgtgagacatggaattcaaaggagataattttggagctctaagatttaactgccctgctagattttggacttgcatgaggcctgaagccccttcgttttggccatttcttctatttggaatgagtatatttacccaatgcctgtacccccactgtatctgggaagtaactaacttgcttttgattttacaggctcatatgcaaaagggacttgccttgtgtcaaatgagactttgatctgtggacttttgagttaatgctgaaatgagttaagactttaggggactgttgggaaagcatgattggttttgaaatgtgaggacatgagatttgggaagggccaacggtggaatgatatggtttggctgtgtcgccacccaaatctcatcttgaattgtagctcttataattcccacgtgtcatgggagggaccctgtaggaggtatttgaatcaaggggcgtgtcttttccacgctgttctcttgatagtaagtgagttttcgtgagatctgatgattttataaaggggagatcccctgcacatgccctctcttgcctgctgccatgtaagacatgtcttgcttgccctttgccttccaccatgattgtgaggcctcccctgccatgtggaactatgagtcaattaaacccttttcctttataaattactcgtccttatgtctttattagcagcatgagaacacctaatacatcatgcaatatttttctttctgtgtctggcttatttcacttagcataatgtcctccaggcttatccatgttgtggcaaatggcaagatctcatttctttttaggccaaataatatttcattgtgtgtgtgtgtgtgtgtgtgttacacactatagtttctttatccatttgtccattgatgaacatttaagttgtttccatatcttggctattgtgaacaatgctgcagcgaacatgagagtgcagatatctttatgaggtggtgatttcattgcttttgggtatatgcccagagagggtcatatggtagttctatttttaatttatttagaaacctctgtattgttttccataatggtcataccaatctacatccctaccagcagtgtacaagagttctcttttctccatgcctgtggcaacattgttatcttttgactttttgataatagccattctagtgggtgtgaagtggtatctcatagtggctttgatttgcctttccctggtgactaatgatgtagagcattttttcatatgctcattggagatttttatgtattctttaaagaaatgtctattcaggtcttctgaccattttgtagttaggtgtttgtttttctgctattgagttgtatgagttctttatacattttggatgttaatctcttgtcagatatatgatttgcaaatattttctcccaatacatagactgccatttcattttgttgattgtttccttttctgtgcagaagctttttagtttgttgtagtctcatttatttaattttccttttgtggcttgagcttttagtgtgatatgtaaaaaatcattgtcaaggccaacatccaggagcttttctcttatattcccttcaaaaagttttataatctctggtcttacatttaggtcttttatccatttgaatttattatggtataagctaaagattcaattttattcttttgcacgtggaaatccagtttttctagcaccatttattgaagagactaccctttccccattgtgttctcttggtgccgttgtcacaaagtaattgactgtatatgtttggattttttcctgggcgctctattctgtttcactggtctatgtgtctgtttttatgccagaacaataccattttgattactataggtttgtaatataataaattatataatataatcaggaagtatgatgcctccaattttgttttcctttctcagaattgttttgtttattcaaggtcttttatgtttccatacaaattttaggatagtttttgctatttctgtgaacaatgccattgggattttgattgggattgcactgaatcagtatattattttggatagtatggacatttcatcaatattaatttttccaatcgatgagcatgggatatctttccatttattggtatctttttcagtttatttcatcagtgttttgcagttttgggtatacatatctttcacctcattggttaaatttattaagtatgttttcgatgctatcataaatgggattgtttatttctttttcagttaggtaattatttttgtataaaaatgttactttttttgtatgttgattttgtatcctgcaactttactgaattcatttattagttctaacagttttttatggacttggggttttttacatataagatcatctcatctgcaaatagagataattttacttcttcctttcttatttgggtatcttttgtttctttttcttgtctgattgttctgtctagtactttcagtactatgttgaatagaggtggtgggagtaggcattcctgccttgtatcacattgtagtggacaagctgtaagtttctccttattgattataaggttagctgtgggtttttcataaaatggccttacattatgttgaggaacattaatacctaaacttttgaaagtttttgtcaaaaaaggatgttgggcttttttgaatgctttttctgcatcaattgagatgatcatgtggtttttatctttcattttgttaatgtcatatgtatcacatggattgatttgcttatgttaaaccagtcttgcataacagggataattcccacttggtcagcttatataatctttttgatgtattgttggattttgtttcctaatattttattgaggagtttttgcattaatattcatcagtagcctttagttttcttttcttgtgatgtctttatcaagcttaagaattcaggtgatgctggcctcataacatgtgttggaaagtattcctgctagctctgtttttagaagagtttaagaagtattggtgttaattcttctttgagtgtttggtagaatttagtcatgaagctacctggttttgggtgtttctttgttgtgagatttttaattacttctttaatctgtttatttgttattagtctgttcaagctttctatttcttcctgactcaatcttggtaggttgtatttttctaggaatttatttatttcctctaggttatccaattcgttggcatataattgttcataatagtctcttttaatttctttttctttttcttttttttttttttttgaaatggagtctcgctctgtcgcccaggctggagtgcagtggtgcgatcttggctcaagctttgcctcccaggttcatgccattctcctgcctcagcctcctgagtagctgagactacaggcgcccaccaccacgcccagctaatttttttttatttttagtagagacagggtttcaccatgttagccaggatggtctcgatctcctgatctcgtgatcctcccacctcgacctcccatagtgttgggattacaggcgtgagccaccgtgcctggccgtctcttttaatttcttaagtgtcttataattttttcactttcactttcattctatttgagccttttctatttttgtcttagactggctaaggatttgttaatattgtttatttttttcaaacaaccaactcttagttttattgattttttctatgatttttctgttctctgtttatttctgttctgatttttatgatttctttccttcttctaattttgggtttagtttgtgcttcttttattagttacttaaggcataatgttagactatttatttgggacctgtcttaattcattttgtgttgctataactgaataccacagactgcgcaatttataagaaaagataaatgtttcttgtagttctggaggctgggaagtccaagattgaggggcctgcatctggcgagggccttcttgctgtgtcactccatggcagaaggtggaaggacaaaaaagtatgagagagcaagatggggccaaactggcttttataacaagcccactctcacaataactaattcactctcacagtaataacaacctattcatgagggcaaagtcctcattacctagtcatctcttgttaggcccacctcccatcactgttgcattggggactaagtttctaacaccatgaactttgaaggacacattcaaacaatatcaggatccttcttcatttttaatgtaggcatttattgctataaattcccttttagaactgattttgccatatcccataggttttggtgtgttgtgttttcattatcgcttgtctcaagatattttcaaattgcccttttgatttcttctttgatccagggcatgtttagttatttgtgaattttccaagatttcttactgttattgatttctagtttttttataattatggtctaaagtgacactagatatgatttcaatctttctcaatttattaagacttgttttgtggcctaacatggcctatcctggagaatgttccatgtgcattagagaaaaatgtatattcagctgctcttggatggaaaggtttttttatacatttgttaggcccatttgatcagaagtacaatttaaatccagtatttccttatgaattttctgtctggttgatctacccattgatctacccattgaagaaagtgagatactgaagttccctactattttttttggagatggagtctcaccctgtcacccaggctggagtgcaatggcgtgatcttggctcactgcaacctccacctcccaggtttaaatgattctcctgcctcagcctcccgagtagctgggattataggtgtccaccaccacgcccagctaatttttgtattttgagtagatggggtttcaccgtgttagccaggatgaactcttgatctcatgatctgcccaccttggcctcccaaagtgctgggattacaggcttgagccaccacgcccagcctgaagttccctactattattgtattgctatcgatttctccttttatgtccattcatatttactttatgtatttaggtgctccaatgttagattcctatatatttataattgttatgttttcttgatgaattgacttctttatcattaaacaatgaccttctgtgtttcttgtaaaaatttttgactggaagtctgttttgtcagatataaagatataagcacagccactttgctctcttttggttaccatttgtgtagaatagcttttcccattcctttgctttcagcctatggccttaaagcttaagtgggtaccccatagacaccatatagttggaccttttttttttttaatccattcgactactctatgtcttttgattggagaagttaattcacttacattcaaggttattattaataggtaaagacttactactgccattttgtttattatttatggttgttttttagcttctttgttcctttctttctctgttgtctatctttgtgatttgatacttttcttagtgctgaactttgagtcctctctgtttatcatttgtatatctgctgtaggtttttgttttatgtttaccgtgatgcttacataaaacatcttatagttataataaactattttaagctaatttcaacttctatcacatgcagaaactagacttttaccttcgttttccacaatttatatttttgatgtaacaatttacatctttttatattgggtatttttaacaacattataattttagttattgttaaccatctttttttctttttctttttcttttcaacttttattttagattcacatggtacatgtgtaggtttgttaactgggaatattgcatgatgctgaggtttggggtatgaatgattctatcacccaagcactgagcatagtacctaatagttaatttttcaacccttgccccctaccccattcccttctctaattgttcccagtttctattgttgctatctttatgtctatgagttgttcactgttttgacttataaccatactagagttatgtatgatttacacaccattacaacagtattggaatattctggatttgagtatgtatttacctctaccagtaagttttagattttcatatgtgttcataatagtaattatcttctttatgtttcaacttgaagaacttccttaagcatttcttgtagggcaggtccagtggtgatgaattccttaaattttttcttgtctgggaaaaactgtctccttcatttctgaatgacagacttgctgggtatagtattcttggctgactgtttttttttttttttttttctttcaggactttgactacatcatttcattctcttatggcctacaaggtttctgctgagaaatccactgatattctaatggatattcctttgtatgtgacttgacatttttctcttgctggttttaaagttttctctttgacttttgacagtttgatgatagtgtaccttagagagggcccctttgggtagtaactgtttgcgaacttttgagctttgtgaatctggatgttgatatctctcccaagacttcggaagttgtcagcaattgtttcattaaataatatttctgtccctttctctatctcttctcctttgaaaatcccataatgtgaaagtttgtttaatgtttgcttaatgatgctccttaagtcccataggctgttttcactctttttcattccttttatttttactgagtcatttcaaaaaaaaaaccaccatcttcaggttgacagattctttcttctgtttgatctagtctgctattgaagttctctctattgtatttttttaattttgctgattgaacttttcagctccaggatttatttttggttctttttaatgatatctatctctttgttgaatttatcactcagatcataaattattctccaatttcattgaattgtttctatatcttctgtggtatcttgctgaatttccttaacattaatattttgaactcattttcaggtaatttgtaagtttacatttatttggggttaattattggagaattattccattcctctggtagtatcatgcttccttgctttttcatgttttttgtgtgtgtccctgcgttgatggctgtgcatcagttggtgtagtcacctcttccaaactttacagagtggtttttgtatgggaagacattcacctgaagatgggcctgagggtgacaattgagcagactatggtgactctcattccatgtgggcacaatggtgtagtctttgtgcagcttatttagttgtaatcaatgtctatgaagactgcagaagcctcagtagtctaggctactggagtttgttgcagtgatggtggcttcataggttattagggcaacagctttagggatcctcctggtcttacttttcccacagtggggtgtctgagctgtgggtatctgtgttggtgtcagatctgacatggccaataggcagccacagtggtacttagatccagggcacaggtgctcagagcagctgtgaaggtgatttcctgggtgcagggtcttgtgaaactatggtagcacacaaaacttgaggcatatgttcactctccaaggcatgaatgactgcagttttcccactaaccagggactgttgctctgtggcacacttcagaaggttgggtccaggggactgtgatatagctgtggttctgaccagctaattccaagctggttccaagctgattctgaatgggggaatagggtggcagaggcaaggtgtttctttcccttccctaagcagccatcctgggtttgtgtgctctataggttttctgctgcttctttgatgttctctggtgctctcctttagtcatttctgtcaaaaatgtagtcatttattcattgttttgtttttatgtgtgtgtggtagacaaaacagtactgggaacttctctttggccatcttgctaatgtcattctttttttcctctcaatcactagtcttttcaaaagaaactccatgtgtcacctattagagacacttatataaagtttttattctcctagtagattgaaagctccatgaagccaaagaccaggtcttaaatatcccctatttttgcccgtaaatcctaatacattgaaggaactcagtaaatatttatttattgaacagtgaataatagcacttctgccaattggtaagatgggcataaaatggtatttcctgactactgcttgttcacttttgagaaaattcttccctgtatagtttgcattcataggtctggatatgtgaatgtaagttttagagttgtgggggggacttaggtcatgttatacacctaccatgtttttaaatgggaaacctgaggttttgtttaaggttaccatgccaggtttttctccatttcatatttttctttttatccatttatcacatttgagtacctgctgtgtatgagccccaaaaagcaaatggtccatttcctttatgaagtaagaggcaaggtcattttctgaaaagggtggagctggggaatagtgctctggaggattgagaagattggagaatttttaaaagttatggcagagtctacggccataccaccctgaatgagcctgatctcgtctgatcttggaagctaagcagggtcgggcctggttagtacttggatgggagaccacctgggaataccgggtgctgtaggctttggccgggcgtggtggctcacgcctgtaatgccagcactttgggaggccgaggcgggcggatcacgaggtcaggagatcgataccattttggctaacatggtgaaaccccgtctctactaaaaattcaaaaaaattagccgggcgtggtggtgggcacctgtagtcccagcttctgaggaggctgaggcaggagaatggcatgaacccgggaggcagagcttgcagtgagccgagattgcgccactgcactccagcctgggcgacagagtgagacaacgtctcaaaaaaaaaaaaaaagtggcagaaagtgaaaaagaaaaccacagcaagattggtgagcagatttcaggagtctgctgcaagtgatttttattttatgtattgaaacacatctgcctgttttgttactttgccctataacttggctactggagataagcacagagaaagtgaacggtaggaatgatcaatggttagaatttggcctagatgagtacaaaaacatcattatcattatcaataacaataacatcatcatagtgagttcagaggttttgtggttttggcaagagtgtaacagcattgatacattatggaacctaagctggatagggaaggaagtgaagaaaattttgattaatagggagaaagtagaggaagaagggtcagtaaactagaggtcttgatgacctgaaagaatagtgatagtaggaatagttgaaccagcaaagctggaagtttgtgatcgagaatttcatgtttgaattagtgattttggagatggagtaggaaagggtgatggaaacttccaaggtgtacagagtgagtggctcatatggaatggaaggatgaggtcattggagatgaagaagttaaggaacggaaaggtcagcatattcggtatgctataccacactttcatgaatttatcttccttttagatggtaacaaaaatacatcctacacccaggcaattttactgtattcaaaaaaaaaaaatcatttagaagcaaagttattggtgtgaggtgaatatattctatagtctgaatcaattcatgagatctaataatgttcggtaactatttcctccatgatcagttttactatgaaatttattgtctgaatcaagctttgccttaggtggaggatggggtctttattagtgttcacaagagacatgtttaaatgtcagctctaggacagctattctaggctattcaaagtctattctccaaggaatttgaagagctctcagagtggatatattaaattagctgttgcagtaagaaagatgtggaattttcaatctctgcctctttgctatcccctttgtctttggacatggtcacattccctcatctaaaaaacatttcctggaaccctgctgccccgtcaagctacctctcaactctcttcttcctttccttgctataaatatttacttttctctttatttattgaaaacagctaatttttattgaacaatattgtaggaaaagcctatctatctatctatctatctatctatctatctatctatctatcatcataatacatagcttttgttatttggggtatacttttctctgttacatatgtacctttttttccccatagtttgaatcacaaactgttaagtcttatgagggtagaaggtctgtctattttgtctgccactatatagctagtatatatgcctatcacataggagggactccataatcaaatgtgaaatgaataaatggtgtatattttaaatttgtattttgattttttctatttaacataagtatttccctttttcttcagactttattatattcaaaaagtattttattgttttaatagatcataaatcactactttttgtagttggacatttcaagtattttacaatcatttactattaccaacaacaatgtaatgtacaacctttagcattaatgtatttgcttgatattattctttcatggaacaattttttaaaagttaaattccagggagtgggattactgggcaaaagtgagtattttcattctggtgagcttgttgaaagaattgaataccttttgccttcatgtcctgactccttcctaagtggcttggaatttggctccttcctctaccacttcaaagaaatacttcttccaatggcttcctatttgccaaatcagcctgtttgttttgagctttaagaaccttcttgacttttcttgtaacgtttaatactaatttactaccaccttctactctcttggcttcatgacatgtcattattttggttctcttgttgcctccctgactgatgtccttccttgaacctctgaagtgtaacctttcccaaggttctgtcctgtcccctccaacactattatctctgttttatttttttcttttttgaaacagtgtcttgctttgttgaccaagctgcagtgtagtggtgtgaccttggctcattgaagcattgacctccaggcccaagagatcctcccacctcagcctcctgagtagctgggaccaaaagcacatgccaccatggccagctaattaaaaaaaattgtagagatgaggtgttgctgtattgcccaggctggtctcaatctcccaggctgaagcaatctgccctcctcagcctcccaaggtgcagggattataggcatgagcctccatgcctggtttctctatatattttagtaactcccaaattattatatctagccctgacttcattcttaagcttcagatttgcatttcatttcttgatctcccattagtgttcaatattgtatactcatcgtgtctaaaaatgaattaatttccaccctccaaatcagttccctgtaactattccatttctgataatgctgttgccattcctaaaatctggacaccatggagacattttgatccttcctcctcttttgctccacctattccattagttgccctgctatatgaattcactgtccctaattttttttcaaattttttttcttaattgattcattcatttatttaacaaatatttattaagaactaccatctaccaggtactatttatggaaccaaagatatagcagtgaacataacagacaaaaattctggccctcacagagccaatagtctagtggaggaagacacacaagcagataagtaaaatacatagaatgtcagataatacaaagttatatggagaaaaattagggaagttggagagagaaggtcaagacaggatgtgtatgtatatgtgcacattttaaaattgggtagtccagggaagctaactgagaaggtgatatttgagcaaagatctggaggcagtcaggaaagagccaggcaaatatgggagaggataagggagcattccaggcagaagaagtagcaaatgtaaaggccctcagatgggggagaacatgagtgttccagaaatagcaacatggccattgtgactgaagcagaatgagtaaaaggaagagtaatagaggtgaggtcagagaggtaagaggagaggaacagatcatgtagggctttgtaggtcattgtaaagactttggctttgtgttatgagtgaaataggaaaccaatggaggggcttgagcaaaggggttacctgatttgacctattttattggtaggaaaactttagctgctgggttgagactagactgtagcagggcaagggtagaagcaggaagtaagtaagggggctattgcagtaagttaggtgagagctgatggcttggaccagagtagtggtggtgaaagtggtaaaagattgttggattctgaatttactgttgattgaacgtggcatgtgagaggaaacagggaagtcaaggatgtctttgagattttggcctcaaatggaagaatgagtttttctgtgtgtgtgtgtgtgtgcgcgcgcgcacgtgtgcttgtgtgtgtgtgtgtgtgtaatctctaatttcttggactctcaatatatattttattctgttctataccatacttaattttcacctgggctgtatcaataatcttgataaatgttcagtggtgaatcagatctcctcttccagcctctcttctcactccagttcaccctttataaagtgaggcactaatcatatcttcagtggtttcccattgcacttaattcagtaggtggactcccctgtcttggattcaaggccctccataatatgagcccaacctatttatttggctttatcctttgctgttttcttttttttattattacactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaactggccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctggttcaaatggcatttctagttctagatccctgaggaatcgccacactgacttccacaatggttgaactagtttgcagtcccaccaacagtgtaaaagtgttcctatttctccacatcctctccagcacctgttgtttcctgactttttaatgatcgccattctaactggtgtgagatggtatctcgttgtggttttgatttgcatttctctgatggccagtgatggtgagcatttttcatgtgttttttggctgcataaatgtcttcttttgagaagtgtctgttcatgtcctttgcccactttttgatggggttgtttttttcttgtaaatttgtttgagttcattgtagattctggatgttagccctttgtcagatgagtaggttgtgaaaattttctcccattctgtaggttgcctgttcactctgatggtagtttcttttgctgtgcagctctttagtttaattagatcccatttgtcaattttggcttttgttgccattgcttttggtgttttagacatgaagtccttgcccatgcctatgtcctgaatggtaaagcctaggttttcttctagggtttttatggttttaggtctaacatttaagtctttaatccatcttgaattgatttttgtataaggtgtaaggaagggacccagtttcagctttctacatatggctagccagttttcccagcaccatttattaaatagggaatcctttccccattgcttgtttttgtcaggtttgtcaaagatcagatagttgtagatatgcgacgttattcctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaatactgtgaagaaagtcattggtagcttgatggggatgacattgaatctgtaaattaccttggacagtatggccattttcacgatattgattcttcctacccataagcatgtaatgttcttccatttgtttgtatcctcttttatttccttgagcagtggtttgtagttctccttgaagaggtccttcacaacccttgtaagttggattcctaggtattttattctctttgtagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctacatatacaatcatgtcgtctgcaaacagggacaatttgacttcctcttttcctaattgaataccctttatttccttttcctgcctaattgccctaggccagaacttccaacactatgttgaataggagtggtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggcgttttctgcatctattgaaataatcatgtggtttttgtctttggttctgtttatatgctggattacgtttattgatttgcgtatattgaaccggccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggcttttgtatcaggatgatgctggcctcataaaatgagttagggaggattccctctttttctattgattggaatagtttcagaaggaatggtacgagttcctcctcgtacctctggtagaattcggctgtgaatccatctggtcctggactcttgggttggtaagctattgattattgccacaatttcagatcctgttattggtctattcagagattcaacatcttccttgtttagtcttgggagggtgtatgtgtagaggaatttatccatttcttctagattttctagtgtatttgtgtagaggtgtttgtcgtattctctgatggtagtttgtatttctgtgggatcggtggtgatatcctctttatcattttttattgcgtctatttgattcttctctctttttttctttattagtcttgctagcggtttatcaattttgttgatcttttcaaaaacccagctcctggattctttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagatcatctttatttctgccttcatttcgttgtgtacccagtagtcattcaggagcaggttgttcagtttccatgtagttgagcggttttgagtgagtttctgaatcctgagttctagtttgattgcactgtggtctgagagatagtttgttataatttctgttcttttacatttgctgaggagagctttacttccaagtatgtggtcaattttgtaataggtgtggtgtggtgctgaaaagaatgtatattctgttgatttggggtggagagttctgtagatgtctattaagtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttgtgaatctgggtgctcctgtattgggtgcatatatatttaggatagttagctcttcttgttgaattgatcccttgaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatactgttatgtgtgaatttgatcctgtcattatgatgttagctggttattttgcttgttagttgatgcagtttcttcctagtctcgatggtctttacaatttggcatgattttgcagcggctggtaccggttgttcctttccatgtttagcgcttccttcaggagctcttttagggcaggcctggtggtgacaaaatctctcagcatttgcttgtgtgtaaagtattttatttctccttcacttatgaagcttagtttggctggatatgaaattctgggttgaagattcttttctttaagaatgttgaatattggcccccactctcttctggcttgtagagtttctgcggagagatctgctgttagtctgatgggcttccctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcctgcagagtgttttccaacttgggtccattctccccgtcactttcaggtacaccaatcagatgtagatttggtcttttcacatagtcccatatttcttggaggctttgctcgtttctttttattcttttttctctaaacttcccttctcgcttaatttcattcatttcatcttccatcattgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttgttttgaatgtcctcctgtagctcggagtaatttgatcgtctgaagccttcttctctcagctcgtcaaagtcattctccgtccggctttgttccgttgctggtgaggaactgtgttcctttggaggaggagaggcgctgtgctttttagagtttccagtttttctgctctgttttttccccatctttgtggttttatctacttttggtctttgatgatcgtgatgtacagatgggtttttggtgtggatgtcctttctgtttgttagttttccttctaacagacaggaccctcagctgcaggtctgttggagtacctggccgtgtgaggtgtcagtctgcccctgctgggggtgcctcccagttaggctgctcaggggtcaggggtcagggacccgcttgtggaggcagtctgcctgttctcagatctccagctgcgtgctgggagaaccactgctctcttcaaagctgtcagacaggggcatttaagtctgcagaggttactgctgtctttttgtttgtctgtgccctgcccccagaggtggagcctacagaggcaggcaggcctccttgagctgtggtgggctccacccagttggagcttccagtctgctttgttcacctaagcaagcctgggcaatggcgggcgcccctcccccagcctcgctgccaccttgcagtttgatctcagactgctgtgctatcaatcagcgagactccgtggacgtaggacactccaagccaggtgtgggatataatctcctcgtgcgccgttttttaagcccctcggaaatgcgcagtattcgggtgggagtgacccgattttccaggtgccgtctgtcactcctttctttgactaggaaagggaactccctgaccccttgggcttcccgagtgaggcaatgcctcgccctgcttcggctcgcacacggttcacgcacccactgacctatgcccactgtctggcactccctagtgagatgaacccggtatgtcagatggaaacgcagaaatcacccatcttctgcctcactctccctgggagctgtagaccggagctgttcctatttggccatcttggctcctcccccctgctgttctcttatatcttccaaataaagtgacttgctgctccttgagtttagtgtttatcaacatgcaatacgttatagatgatgcttatttggaatcacataatggttaagaatataaacctctgtagctggataccccaggtttgaatcataatttcatttctcattgtgcctttggacagtttgaccactatatcttagttttctatctctaaaatagggataatattaataccagtctacttcatagaggtgttttgaggattaaaggggtttatatttaaaacacaaaaacagtgcctgaccaacatgttaagtactctaatgtcttggctgtcattgttgttattatcgttactattcttattgtctctttctctccccactgtaatatcaggtctgtgagggcagggatttttatctgctttgtttactgttctatccctattgcctacaacagtgcctggcatataataataataaatgctcagtaaatatttgtgaaatgaacaattgcagtttccttagcccaagatgactactactgctgtctcttccccctactctcttctctcaagaacctgtccaaactacaaggcttattatgaatgccatgtattccatggaatacttcatgattttctgatctttctccccaagctaagtttaatctctcatttctttgaattcccataataacttacttatggttttcttacatctattacatttatttgcctttcatcttagtcatttttatctaatctcgcttactagatattaagttcttaaacggcagactgtgtcttactcattttatatcccttgtgatgctagtataatgccttgaacatggtagatgctcaatagacatttgctgattgaactgaatctgttttactatttatatacttagttgtatacaaattttcagatttctaagtcatacttccaaggtattaaatctctgtgcaatttatttcttaggtatcctaagtgttcaagcttagaaagactatgcttttttatctgcagttgcagaaaaaatagatttgtcttaaatcttgttttaactacctaaggaccttataccagattatgaaattgtcctgcatatatgatcctaaaggggaaggtttatcaaatatagcaatatacagctggaattcaatgatctagtacatcacctaagaactcagatgaaaaaaggctttgtgcagataaagtgtgtgtcacaagatccatgcacttaagctcatgcatgttacatagtgtaagattctgagatactcgcttataatttatttactcatcattatgctttaatcatgattatcatatttcctcgccaacagctgtggagaggccatttagaaatgttaacaaggctcatcgaatagtaggagggagagacagctgactctaaggaaggagacagaaaaaccgaaaaacaaaccaggaactcatagcagtgtgggtctaatagccctatatgacttaaataagtcttgagggcatcaacatgttataatatagctcagtaattgatgttcataataatgacccaaattcatcaaaaaaacaattaaattgtgatcatctactatgttctatttgtgaagataagcaatgagtattgagtgtttagatttccatccaaaagattaaatttaaaatggtgttgtgtataaagtaataaaccctgaactagcaggacaactcgactaactccttcctgagttacaatcaagattttccttcattcaatatatacctttctgttcaagcctctctaactagaattgaaatgcaatggtaaggcaacatgaggcagtaaatctatgaaaatgaattgttcattcacactacatttataaaacaggaaatacgattataaaacagatgttgactgattgaaatgctgtatgctcaatcatgttagtgtttatttgataaggaatgccatttgtttagctttgcttatttattcagtgactgtggcctggaattttattagatgctgtatagctgtatatctctgcccaccagaatgctgagagaatcttagcttgaatgaaactggataagaagttggagctgtttagctttggtagtgaagatgagaagactttagttttgaaggttttccattttaaatgtctttgttttgttttatttcatttatatatgggtgccagaacatagaagtgactaatagtctggaagtattcattacttgtttaactttattctgaaaactttcatcttcctaaaagtctttcaatggctacccagggagagatcgagagccaagaaaatttcctgaaatggaatcatttataactgatatgtttctgaataatggagaaaacttaaatttaattttaaaagtactgtaatactaaacagctcttatatttgaaataaattattcaactaattttttgttctcccttggagccagttagcaaatatcttttgtgttgcagtgagattacagcaaatgatttcatgggaacatttatttagattttgtattttattttattagctgataatatctgggcctttatgatatagaaactagtacaataaatatttgaatgaatagatttaggaaccagataatttggaaggataatttcaaaacttgagtgaactatgacatttaaaaccagcatcttggatcatcatgtaacatattgtgtaatatacattatagtgaaatagattttaaaatttaataccttaagcaaaatattttaggaagaatttttctttcttttaaagaacaagataaataggtttctagtcccccacatccaaatatttttgtgtccattttaccctcttgataaaggcagaaaagggtttttatttgttcctaatgcagattaagagttgttaacctctacaaactacacagccaaactaaagtcagttcagaaggatgtgatatgttatataaatgtagtatgttatgcagcattacaagttccttataatctcaacaaatagcatttagaatttactaattgatttaaaaataaaaaccaatgcatgttaacataaataacataaatagcattttacaaacaataatttctacttcatcaagaacattcttaagtgaaatggcatgtctttcttttcttttcttttcttttttgttttgagacagagtcttgcccttgttgcccaggctggagtgcagaggcacgaactcggctcactgcaacctccgcctcccaggttcaagcgattctcctacctcagcctcccgagtagctgggattacaggcatccgccaccatgcttggctaatttttatatttttaattgagacagggtttcaccatgttggccaaatcctgagctcaggtaatccgcccaccttggcctcccaaagtgttgggattataggcatgagccaccgcgcccagcctgaaatggcatttctttctctgaaaatgcatgatggtaaagaatacaatggccactaatataggttggtgtccctgccttaatccatgcaaggcaccaacagtttttgcaccactattttttaagataacagctttattaagatatagtttagataccatatacttcacccatttcaagtgctaattcattggtttttagtacattcacagagttgtgcaactattatcataatcaattttagagacacaaaaggaaaccctgtacctataagtagtcactacccatttttcctgaaccctctcctcttccagcccctaggaatcatatatctactttctgtctctatagatttgaccattctggacatttcatttaagtggaatcatataatgtataatcttttatgactggctttttcacttagcataatattttcaggattcatccatatgaatcctgtatttcattctttttatggttgaatgatattctattatatagttatattacatttatctattcatcaatggatggacattaggttgtttccattttttgcctgttgtgaataatgctgctctcaatatttgtgtacatgtttttgtgtaaacatttgttttcaattctcttgagtatatacctacaagtggaattgctgggtcatatggtaactctctgttgaactttttgaggaacttccagactgttttccaaagtggctgcaccatattacatttccacaagcaacatatgagggttccaattactcttcatccttgtctacacttgttattgtctattttttattatattcttcctagtgaatttgaagtgatatttcagttgtggttttgatttgtattttcctgaagactaatgattttttcatgtgctcattggctacttatacgtatcctttggagaaatgtatattcagatcctttgcccatttttcaattgagtagtttttttttttttttagttgtaagtgttctttatatattctggatatgagtctcttatcagatatttaacttgcaaatattgtctttcattctatgagttgtttcttcactcttatttgtgtgaaggaaaagaaagggagtattgccatcttaacaatattaagccctccagtctatgaacatgagatgtcttttcatttacttagatcttctttactttctttcaacagtgttttgtagttttcagcataagttctacccatcttttgttaagtttattcttaaacttttatgctgcaaagtttaatgtccaatttatctaattttccttttgtggcttctcctttaggtatcattttaaagaaagtattgcctaacccaaggtcacaaggatatacattaatgttttcttctaagagttttatagttttagcctttacatttaggtctgtgatccattttttattttattttatttttattttggcaagcctgtacaacctgcactgagggatgcattgatgcagtcaatatctgaagatgaactattaaaaagtaagtgtaaaacagtgtcttaggttagggtccctgagaaatacactctaagatggagttagaatataagcagtttgttggggaatgcactccgatcaactcctgtggggaagtgaaggaaagcattgagcagtagaaggagttgagctgttagtacaaagtcttcacaggagctctggggcttggatggcaaaatgagaatactttcacgttgaagggggcctttgtaccctaccctcttcacagacttatcaagggattttcactgccctgggaaaaagaggttctttctggacaaaggtaattttcttgagggatttggttgagactcagcacctcattcctgaagcaaggaacaggacaacatacacctcacagtggcagtgttaattctcaatggaggaactgtgttgggatactatgggggaaagaaaagacaattagtatgtggatatgcctctatgtcagtgaaaactttcatagaagaggtgatacttggactgccttgcaatatggaggtgtatttatcaggtagtatagagaaatagtattccactgatatatgtaagcaaagcctggtgctttttatttattttttttgagacagagtttcccttgatcgcccaggctggagtgcaatggcatgttcttgactcactacaacctccacctcccgggctcaagcaattcttgtgcctcagcctcccaagtagctgagattacaggcatgcaccaccatgcccagctaatttttgtatttttagtagagatggggttttgctatgttggccaggctggtctcaaactcctggcctcaagtgatctgcccatcttggcctcctgaagtgctgggattacaggtttgagccactgcacctgacccaaagaaacatatgtcactcagagtggcttagagtgtaggatccaggaggagggattgaagaggaggataatgaggtggtgacaaaggatgaaactgcagaagtagcaaggtctaggctatggagaggtaaatggcatgcccagaagtttgtattttattttaacagcaaggcaggcctttaagcaaaggaagatcttgtatgatacgtgctttatttaatttttatacgtggtgtgaggagtagatccaacttcattcttttacttgtggatatccagttgtcccagcaccatttgttgaagactgtttttcccctattgaattctctcggcactcttgtcaaaaatcaattgattgtaaacgtaagcgtttatttctagactctcaattctactccattaatctatatgtctgtccttatgccagcagtactacattgtcttaattactttgtagctttgttgtaagttttgaaatcaggacgtatgagtcgtataactgttcttctttttttttatttattattattattatactttaagttttagggtacatgtgcacaatgtgcaggttagttacatatgtatacatgtgccatgcttttttttttttgagacggagtcttgctctgtcgcccaggctagagtgcagtggcgcaatcttggctcactgcaaactccgcttcctgggttcaagcgagtctcctgtctcagcctcccgagtagctgggttcaagcgagtctcctgtctcagcctcccgagtagctgggattacaggcacccaccaccgtgcctggctaatttttgtattttttagtagagacagggtttcaccatcttagccaggctggtctcgaactcctgacctcatgatccacccacctcggcctcccaaagtgctgggattacaggtgtgagccaccgcgcccggcccaactttgttcttctttatcaagattggttttggctattctgtgccgctgaatttccatatgaattttaagatcagcctgtattttgataaggttgtgtttaatctgtagatcaatttagggagtattgccatcttaacaatattaagtcctctagtctataatgtgggatgtcttttcatttacttagatcttcgttactttcttacaacaatattttgtagttttcagtataagttctacacatcttttgtcaaatttattcctaatgttttattttattttgatgctattataaatgggattgtttcttaaattttatttttcaatagttcattgcaaaaatagaattagagctaatttttaatattgaccttgtatactgcaaacttgctaaacttgtttattagctttagtagggtctttgtgtgtgtgtgtggattccttagactttgctctatataatattatgttatctgcaaacagagagagttttctggatgcctttcatttctttttattgcctaagttcataactataacctctagtaacaatgcgttgaatagaagtggtaagagcagacatccttgtcctgttagggggaaaatattcagttatcacttagtataatgttagctctgggtctttcctaggtaccccttaatgtggttgaggaagtttccttctattgctaattttttgagtatttttatcatgagagagggtattgaattttgtcaacgtttttccatgtgtattgagatattcatgaattttttcctttattctattcatatgatatattaattgattttctgatattaatccaaccttgcattcctgggataaatttcatttggtcatgttatacaatcctttttatatattactggattcagtttgctagtattttattgaagatttttatgactatattcataagatatattggtctatagttttcttgtgatatctttttctggttttggtaacaaggtaatactgatgtcatagaatgagttgagaagtattccctcctcttatatttcttggaagagtttgagaaggatgggtattaattgttctttaaatgtttactagaattcatcagggaagccatgtaagcctaggcttttctttgtgagtaatttttttattacaaattcaatcacttgttttaggtctatacatcttttatatttcttcctgaatcaatgttggtagtttttgtttttctaggtactttcccatttcatctaagttatataatttgtatacatacagttgttgatcatattcccttatagtccttgatgtatgtttatggttaatagtaatgtcctctctttcattctgaattttagtaaatcgagtctttatttttggcttcatcaatctaactaaaggtttgtcaattttgtggatattttcaaagaaaaaaatcgccttttgaaaagagaagtagcaaattaatcatttgaaggcagctagtaaccactatataatgacctcactgacagtgtgttcctggccacatgtttcttaacctcctggaacctcagttgcttcatctataaaatggggcgatatggcttgcctcatagatttgcctttaaaattagatgaattaacgtgtaaaatctctagcacaatacctatttatgacagatattgtacctttcagtaaatgcttgtatctttttcttccacattattgtgctgaccctggttttactgcattattcttcagtagccagctttaatttaataaagtaaaccttaaaaatgacttctcttttaaagtctgaaaaaatatttttgtgctttttcttctaccatataatcaagatgatatttattttcactaaaatttaggcatataaccaatttcagaatgtaagcaggtgaaacattggtttaatattaatcataaatgaaagtaaaagcacagctgggattgtatataataaattatcatgctctgtattattttcatctttttctcatctcagtagtaattttatttcctattaaatatccatagagataatttgtttcttcttaaagtagagcaccatctctcagataactttaacatttctgagacaattctgaccttttaatgaactttatgatagttcagcagtgttataaataatgaacctgaaactctaaaaagttaccaaaacttctttcaaattgtggtatataatttattcaagtaaagaaaggtaactctaatcaatttttatattttattaaaagtttctacgtcctattagtaggatttatattctctctttcctaagtatcttttgtcctaacttcctccataggtatgcacctttattgcttgccagtaacttgaggaaataagaacatttcttccagactttgagtcaatgaaaattgactcccatatggaaataggaattgaatgctactgtctcatgtatgaactcggtatttggcctagatcttttccctttctctgaaatgaggaagatgttatggtacctcacttcacatgtgcctgaccagctgttgtaacatgtatcttcatgaaccctatgtactggtttcactctatggattgcctgtacagtgggaataattgaattgacaaatagggttatgattaggttatgatagaaactctctagcccagcctgacacaagtagatcacaaaacatctttattctaacactgatggtaggaaagcatctcccagggatgtcggtagagttcccaggggtaactttcatctcaataggtctccaactctaagcagaagacatgttttgccatggaatacagagagtgaaaactcatgaatgaatgagaaaaattcattctcaagagacctgccttagctagctaacacacgtcattagcaatatgatcttgacggaattattaaacatctccaagcttcaatttccatggatgtgggtggtgataacaggattgttgagaaattttaataagataattaatgtaaagtacttaacacagtgcccagttcattgtaagggattttcatcaagttttgtcaaaataatttctctcctatgactcacttgggtgttgtaacaggtccgttaaagctttcttttactatatctgaaatttttgtcctatattcttcagatcagtggttttattattgatgctttgggtttgtgtccctgcccaaatcatgttattgtaggttaaggtaatatttgcctttataatgctactacattattgttcattcattcaataaatatttattgagcacctatcatctgttaaaatctttagacaaattaaagttaaagactatactttcagggatcatttctatagtttattactggagaagtttctttgaatgtatagagcactaaaaaccatattatctcccaagtgtaaagctgcctcttggtgttggtttacttcagttgccatttgccattaatgattgttcttcttttctttggggagaataagagacagaggacacagtctgggtggggaaaaatattaaatttagcagagtctaattgagcaaagaactattcatgaattgagcaaccctcaaaaccagaacaaagggaggggagagaagaagatgacagggttggcaatcactcctctgctttctctgtttaaccaccatgactatgacagctcttcttcacacaggccaaaatcaatctgatctccagagaatggtttaggtgagttaagtgaagtgtggacctaattacatactatactggaaaatactttataaattaagtgctatatatatactatcgttactataataacatttccacctaattcctctcagtaaaacttcattctcttccatgtcacccagctctctgacacaatacctctgatcatacccttctaccatatcacatcttctcacttccccattgtaaataagctttcatgaagatacaatccaattgattcggttaattttgccaatttcagtttttagatgccatttgtcctttcagtctttccggaagactgagggtggtgaagacaatgataatgccattgtattcatgacaccttattcaattgctttataatttgtccagtaaaatagtacttctattgctggagatttctccaggagtgctccataaaggaaatacatgttttaataacctttttagctactgttatagtattggccttcctacatggaaagctcctatccaatcggagaatatagactattatgagaacatactcatatcccatttaagatggcaaatgaatgaaattcctctgtaaatgttcaaatggaccatcagaaagtacaaatgtaccacctgaagtttttattgtcttccaaggattatgggtttgacaaagcaaacattggttataaaccattttggcaatttaaaaatagtccccacactaatattttttcataattggcataattttttatactccatgatgagttatgaagtacagaacttttaataatggaggctttaaggacttgagaaagaccaggtggccatctgtgccctctatgagtccatgcttaatattgaatttatattcttttaaatatcagatttgtttctccaattcaggtgtagcactgtttattaaatagggtaaaataggtaatctgacctcaatcagtcttaaggagttattttaaattgcatatcttaacaatttcagtactggctgacttgttatgaaaatctgccaaagcatttccttagtatttaataattcttgttctgcgtttgggttagcagttttataaaactagtttcttcattagagatctggaaagtctcacctagtctaatggtgtattaaagttatcagaaatctctacttgtcagagtcctttccatgaatctccttgaagaccaaacactttaggcttatagttgctcaggaaagtaccagagtaaacaaccatctgtgaataataatgcttaaaatggccatggttaaaggcctgttgagagttcactacaacgttgatgcaattgacaaggaaattcagttatttttgctgcatacaacattttaagataactagaattatgacttatcattataccaggactactagatttctatgtattttatacaatttctgaaacatgtattaataacacatccatgcaaatataactcaaagggttagctttacttattatttgacaacactttccatataatttaatatattgaataagcccagttagtttatatttctcttttcacaaagagaggtatccttttgagatgttccaagggcctatctggaaaatcccaaagttaattcaaagtcaagaaagagacttaaattataatttgattttgtgaagtttgtcaaaaatatcaaaggttttggcctggcatggtggctcatgcctgtaatcccagcactttgggaggccaaggcaggtggattgcttgaactcatgagtttgagaccagcctgggcaacatggcaaaaccctatctctactaaaaatataaaaattagccaagtgtggtggtgtgtgcctgtagtcccagctactcggcaggctgaggcaggagaatcgcttgaacttgggaggtggaggtagcagtgagctgagatcgcaccactgtagagaaagaaaaagaaaaaggaaaggaagaaggaaggaagagaaagaaggaaaatatatatatatggtttaaaacacttggtcaaaatatgataagtgactgtgaaataacagtaatcatttaaatagagtgataattaaaagactttaaaaggcaaatatagaaacatagttgtagaaaaatccttggctgttttagaggactcagttttccttctttccttctttctttttttttttttttttgacggagtctagcactattgcctgggctggagtgcagtggcacgatctcggctcactgcaacctccacctcccaggttcaagcgattctcctgcctcagccttctgaatagctgggattacaagtgcccgctaccacgcccagctaatttttagtagagatggggttttactatgttggccagtctggtctcgaacacctgaccttgtgatccacccgcctcccgccttggcctcccaaagtgctgggattacaggcatgagccactgcacccagcctcagttttcttaagtaagcaaaaacctaatatagaacgtgaagcacaaggaatcatcttgataaagcacagaatctttgtttcctaggccagttacctaccaaaaaggtaaagaaagaactctcaaaatttcctattacgagcagatcaaaggccagacgcagtggctcacgcctgtaatctcagcactttgggaggccgaggtgggtggatcacctgaggtcaggatttcgagaccagcctgaccaacatagtgaaaccccatctctactaaaaatacaaaattagctgggcgtggtggcacatgcctgtaatcccagctatttgggaggctgaggtgggagaattgcttgaacccaggaggcagaggtttcagtgagtgaagatcgcaccattgcactccagcctgggcaataagagcaaaactctgtctcaaaaaaaaaaaaacgtggatcaagattccaagaaagccttattgtttcaacacaaggtaaaaaattgtagttttgcatcagtgtacatttggtagtaaggctcaatttttagaaaaacttgtgaataatttccttctcatcttagcttgatcacacataaaattactttcataagatttatcttccacaaaccttctataatctttttatgtctcttatttttcatatagtttttggtttctcattttggaacaatcaatcattctactttaggataaaaattaccctctttttttcttcttccgtacctcatagcttcacttactaaaaacatgtcttactttactcacgtacaacggttgttttccttttatttctattttaaattaccatatattgattaggattttcaactcttagtaaccttaatttctagtgaaaacccaggaagtaaaacaacttaaaaccctctgttatatacaaacattttatgaatatgcatttcataatttctagaacacgtgcttcttcatagagtagttttttcatgtttactaatagacccaaatagcatacctatactgtttgaaaacaagatgccaaaatatgtgtactttaaacttacattttgtaattaatattttggtatttttaactttcttagaaatgacctagacatttcatgaatatgtattagagtaattcctcctttactgcagtttcagttatctgcgatcaattgcagttcagaaataggtgagtacaatataatgagatattttgagagagggagagtgaaaggttcttgtattggttcgaaccccaggagcacaccaacagacagaacgaggtagtgtggagcaacacgctgttttaatgagcgcctgggtgcagacgggctgagacctaaaatggcgtcagcaccaaatgaggacagggcagggattttatagtctcctctaaacagaaagtgtctcagtctgatgtaactgctacgcggtaccctgacggcctctctctcagtcttcaggaggtacgtgtcttccagccatctctcttcctgcttctgctatcttgctgaggcacgctgctggtgcaagtggtcttggatcttgggactgggcctgagaagggaggagttattcattccgttaagctttcaggccctggggagaatctttcattcccatctatttggttatagaaaaagggaaaagcgatgactttctcaataactacttcaagcgtgacatggggggtgttgtgggcaccttggaaacaaagaaaaacttaatttttgggttattcttgacagacgggttggtgtccatcgtgtcgttgcagcaggaacatcatctggattgtctggtggttaactgtagtttcagcaagacttttaatagcttttattattagtgggataatacaggggagaaactggaggaacccgatgatgaagattactgtccctaccagtgttttaaatcctcctaaattagagaaccaccctccagaaggtttgttgggtcccacccatcccttccaggtttggactggtacatgggctacttttctgatgtttgaagcaatttctagaactgcttttttgttatcgtctatgttaagacagcaattagagatattaaacttaccacagaccccactctcttctgctaataactagtctagtggtagcctgttttgataaattgccgcatgcatttggttttgttgttgcgggagcatttccagggctggggaggtttggttagtgattatctctagaactgtctgtggcctaattattctgtttagcatatatatgggagtgcgataaccccaggaaccatcctcagcccaagtggcaggaccgtgatattcgatgatccgttgcggaggccatttgtccttttgccatctttggcttccttctacctttaaggattgtttttctttgtttaggttattatatacagggactccgagggtgttgcccactgttaatgttttggaggaaggagtatccttgcggggtgagcttgaccctggtgcgacggatccagtaggggagtccttggattctcactgcagttggcatgctgagtatcacagtgtagggcctgaccacttcggttgtagctttttgagagggttgggttggcagataaacacatctgtgcctgcaagacagttatgttgagaggacaaggaggtgtcgacaggcagaggcatggcctcatttgttgcttcacgaataaaagacagtgtctggattaaggaagggaggtaattcccgagtggctcagagtctggtaagggtggaggccctaaaagaaaagttcggccatacatgatttcaaagggactataaaaagagggtgcttttggtgttgcgcagagtctcatgagggcaaaagagagattttttttgtccacgactgccgggtttctagagttgggcttggtgagttgggctttaaggacagagttgaccttttcaactttgcctgaagattggggcctgtagggtgtgtggagaatccattttattcccaaggatgtagagacgccttgggtaatttggctgatagagtcaggctgttatcagattggatgagtgttgggagtccaaaacggggaattctatgcatgatgagagtttgtgtgacgacatttgcaccttctgaagttgttgggaatgcttctacccacccggagaaagtacagacaaagactagaagatagcagagccatttaccgggcagcatgtgagtgaagtctacttgccaatcttgcccgggtgcctggccccgggcttggtgggtaggaaaaggcagtggcggagggacccctggggtgacactcagtggcagataaagcaggtctgggtgatttctcaaacacggctagaaaggtgaggacaagtgagaatagggtggagaagttggaagagaggtttgtacccgacatggaaagagttgtggagactttagaggataggaattgtttaagagtgaggaagaacgaagcaccctcccttgacataccatggtccttgtttttgaaggttttgggcttggtagtcctctttttcttctgaggagtaaagaggagagaagaaggacagggacagagcatggccgagtttagatgggagctggttagcatggtgatgtggggagtttctatgaatagagcatacacttggaggaggcatggggcagggatgagacttagtacactgcggtgagctagcatatctttgatgttatgggttgaataaactgttaggttggcatggagagatggttttatgcttttaagagtgaggactgcagctgccgctgatgcttggaggcaggcaggtcatccgagaactgtggcttcaagctgtttagagaggtaggcaacaatctggagggtgggtcccttagactgcgttagaacacctagtgcaactccatgccattcgctggtatagagggagaaaggtttggtgaggtctgggaaagtgaggacgggggctgagagccttacggagtagacggaaaggttgggtaatagtctgcgcagggtttaaaggctcatggagagggcctttagcagggtttaaaggctcatggagagggcctttagcagcttgatataagtttggcaagtagagtgaaggagggaacccagagcctaaaatatcccgctagtcctagaaaagagataatttcttgcttagtttgcagaggcaggagggactagaggagggatatgcggtcggttgtgagccgtcgggtttgcggggtaagagctaggcctagataggtgactgagggggtgcatatttgtgctttcttaggggagacctgatacccctgttctgccaagaagttgaaaagagggatagtatgggtgttgcagtctctttgagaggggctacacaggagcagatcattaacatattgaaggagagtggacggttttagggataagatacagaggtcatgagcaagggcctgcccaaaatggtgggggctgtttctgaaaccttgaggtagtatgcatgtgagctggtgtgaaaggtgtcagggtcttcccacataaaggcaaagaggtcttgagaatcagggtgtaaaggaattgtgaaaaaagcatcctttaggtttagaacagaaaaatgggtggtattggagggaattgcggaaagtgaagtatatgggttaggaactactggacatactgggagtacagcctggttaatgagcctgaggtccttgactaagtgataagttccatctggctttttgacaggtagaattggtgtgttaaaaggggagtctgttgggcggagtaggtgactggcaaggaggcgagaaatgataggctttaggcctatgagagctgcttgggggatgggatactgcttctgtgataggaactgggtgggctctttaagggtaatgcggacaggagtgtggtgttttgcgactgaggaaaaaggtgtggaagtatcccaaatagcggggttaactacggatggggaataaggaaaggttgcatgttttaaagtgggaggttggaggagtagaagaaagttagaagcaccagagaggggtttgggttgatgcattgggtactatggggaacgtggaagtggagagtagtgtggagttttgaaaggatgtctctgcctaggagtggagttgggcatgagggcaggactaagaaagagcgagtgaaggaaaaggtgtgcggggagcagaaaagtggagaggtggctcagggtttggagacttgtccattaattcccacaacagagacttgggaggactaggtgggtcctgaaaaattaggtaaagcagagtaggttgccccagtattaattttaaaaaagcatactggcttacctgccaccatcagagttacccttggctcgtatgaagagatggtagttgctggggcatctgttccagggcactgtcggtcttcagtggcaaggctgatgagatctcagtaggaggttttggtcggctcaggaagggatgggggcagtccttgtgggggccactcacagtccgacttccagtggggtcctccgcagagggggcatggcctggtgggcttacctgggtttggtcattgtctggaccagtcgccttcattgccacacttgaaacaggtgccaggtggaggtggattgctaggaggattctgtgtggagctgcggcccttgggcctgcagggccccttatggtggaggcaagcatttgaaactgcctgtttttgcctttcactttcctcatcacgattgttagactttgaaggcaaaattaagaaggtcttgttgtaggatttgagggccaccgtcaagcttctgaagcttgcgccagatatcgggggtggattgggagatgaactgaaggtcccttctgggctggctgggtctaggttggtatactttctcatggcttcagttaaacgagagagaaaaaggtctgggttttcgtcaggaccctgggtgatttatgaaagtttttcatagttgactgctttatggacaccctttttgagtcctgcaaggagacacacaatcatgtggtctcgatggcagcatccaagggcttcatcttgataatcccagtgggggtcctggttggggactacctctgcgccagtaggctgggcaggagcttggtgatgaattgtattagcatacgcctgagctagggtccagatatggtcccggtcttctggggtgagggtggaagagaggataatacagaggtcatgccaagttcataagactgggtgaggtactgaaactctaatataagaggtagggtcttctggaaatgaaccaagtcttttgttaatttgagagagatcagtgagggagaagggaacatgaactctaacaataccttcagttcctgctacttcccaaaggggacactctagcacaggtgctgaagtaagggtggggcatggaccaaagatggtacctgagtgagtacaggtgggagagaaggaagaagccggaagtggttcttgccgagggtttgaagggggaagggggcgttgagctgataggcagtggaggatagataggggcataaggtggcaggatgggtttacagtcctcaggagagggcggtgggggaggagaatgggtacagacaatactagaattgtcctgaggaggggaaggtgtaggaaaagaagtggatactgctgattgggaagatggtggctgggaagatggcagctgagaggatggtggctgggaagatggcagctgagaggatggcaactgggaagatggcgactgagaagataaagaggaggcttgggggactaaaggtggttgagagagagaggaggggtggacagcagtctgctggatccaacaaggaaaaagaggttgggctgggaggagaaaggcgatcagggcggcgagaatggaggagaaggatttgaacaggtgagcaagaattgccgaggttgggttgtgatctgagtgcaaaaaagcctggacataaggaatttctccccatttttccagccgtcagcaataattgcttaagtcagttaaaactgtaaagtcgaatgttcatttgcgggccatttggacccattatctaattcatactgtggccagactgaattgcaaaaaagacaaggtgtttagggcggatattttgtctgaggcctaaggtttgcaagttttttttttttttatgaggcagcctagagggctgtcctttggaatggaagactgggaatttcccataacggagggtaggctcaggagaaaagggaaagggagaccatcttgcatggccgtagggagacgataaaaggagcaattgtcaccgctgcctttttcgttcctggaatgggatcaaatggcttagaagtgtccccctaagaccagatgatcagcgagtgcctggcacacaccggaaccttcttggaccaaggttggattttcggaccggagaaaccaagagaggccgtgcagatttttccctgttaaccaggctcccaggaaactttaccagtaggtgagatcagtgactgatgtgcatgcacagagaggcgactagaggctgaggagtttcctttgtccggctgctgtggcctgctctccagggtggaggcgtaggtccacaggggacatacaccggagcccctcccggttttcggcaccagatgaaaggttcttgtatctgttctaatcccgagagcgtgccaacagacaacacgaggtagtgtggagcaatacgctgttttaatgagcgcctgggtgcagacgggctgaggcctaaaatggcgtcagcaccaaatgaggccagggcaggggttttatagtctcctgtaaacagaaagtgtctcagtcttatgtaactgctacgcagtaccctgacggcctctctctcggtcttcaggcggtacgtgtcttctggccagctctcttcctgcttctgctatcttgctgaggcatgctgttggtggaagtggtcttgcgtcttgggactgggcctgagaagggaggagttattcattcccttaagtttcaggccctggggagaatctttcagagagagagaaagaccacatctatattacttttattgtaatatatcgttataattttggtattttattagttgttgttaatctcttactgtgcctaatttataagctaaatcttatcataggtatgtatgtatagataacaacatagtatatatagagtttggtactacctttggtttcaggcattgatgaaaagagttgaactctgtaaaacatttgaagagatttattctgagccaaatatgaatgaccaatggcctgtgacacagccccagtaaatcctgagaacgtgtgctacagcttggttttacacatgttagggagacaagacatcaatcagttcatgtaatatgtacattgatttggtctggaaaggcaaggcaactggaagctggggtttccaggtcataggcagattcaaagattttctgattggtaattggttgaaacagttattatctaaagacctggaatcaatagaaagaatgtctgggttaagataagaggttgtggagaccaagattttatcatgcagacaaagcctccaggtagcagaggtaacaggcttcagagagaatagattgtaaatatttcttatcagacctaaagggtctgttctatcagttttaaggtctctgttttgatgttaatgttagtcagctgtgcctgaatttcaaaaggggggagggtataatgagaaatgtcccattatcacttgaactagttttcaggttaacttcggaatgcccttgcccagaggtgaggagtggggggagtgggtgggaggatccatcagtgcatctactgggtgtcttggaatttatctcccaaggataaggtggggactactgtacttaatataacatagaaggactttaagattttaagttactgaaaaagatttttgaaattttgacaagttcacttaaacttgtatcccatttacattcacttaatttacttattcttgacaattcttgaattgctcattaaacaaaactggccattgaaggagttcaggaaataccaccctaaaatatgtatatcggtatacatatttttgttatgttgatgactttgagctgaagcacttgaaaaacagcaaaataggccaggcgtggtggctcacacctgtaatcccagcactttgggaggccgaggtgggccattcacctgaggtcaggagttcaagatcagcctggccaacatggtgaaaccctgtctctactaaaaaaaatacaaaattagctggatgtcgtgatgggcacctgtaatcccagctactcgggaggctgaggcaggagaatggcttgaacctgggaggcggaggttgcagtgagctgagatcacaccattgcactccagcctgggctacaagagtgaaactccatctcaaaaaaaaaaaaaaaagaaagaaagaaaaaagaaaaacagcaaaatacagaggctttctgagttccccctccatctgcctaaagactaatgctacaaaaggaactcaattgtcatcagtcctctgaagattaactgttatcacaagagagaaggccagaagtccatcgcaaccagacaaaccttgtcacaacatcatctattctctaaggggcccattcatctttccctaacaccatttactctgaagatatctcttttctttgacctctaaccattttactcatagtagcagtagggattgagtcaagggacctttgtccttttttaaaatgacctgcctgattattgccctaagcaatttttagttaggctgctcattatatttgtctttgggcttttaaaatttctccaaactgaggtaaatagagtggactggtttgggtcactgaaatgttgggggaccaacagggagtccctctggttcatccatcctttgttagattcaacctttgttttaaccccatcagtgtccattttagtcatctcatttttaagaaccatctaaaaattttctacgccaaatttgcatttctaaagtgatggttcttaggtaaaacaaggtacaaaatttatatctcaaaggtacagaactcagatttcagcactaattgtcattatttgctcaaaccaagaaaagaaggtataggtaaaggcccagttaagacaagatggccaagaaaatcaccttaaacaaaggtaaggcttgttatgtaaatttaagtcaatgctttctccattgtaagagcttctaataagagtcctgcctttcttccggtgcagagacagagacagccttataaatggagatttcctttatagatgtaaatttattttacaaaacgtctcaaaataactaaaaataggcagattcccagcccaagtttttaaattagattactgagttcagagtggttcccattaatgcatagggcagacaaagcatcttctatgccagcctaggatacatttcactgttgttctgagtttaagattttgacgaaggcatagagtggttaaagaagcaggccacctttatctgagggctgaacttctctaaacaacttttttatcctgagatgggaaaataagcaaaaaggttaataaatttagagtactatcgatgaaaagtgtcaaactctgtaaaatatttttgaaaagattttttctgatccaaatatgagtcaccatgacccgtgacacagccctcaggagatcctgagaatatgtgcccaaggtgtttgaggtgcagcttggttttatacattttagggagatgtgaaacttcaatcaaacacatttaagaaatacattggttcagtccagaaaggcaggacaactcgaagaagggtgggggtggggaggcttccaggttgtatgtagatttacaatttttctaattggcaattggttgaaagagttatcaatagaaaggaatgtctatgttgagataagaggttgtggagaccaaggttttatcatacaaatgaagcctccaggtagcaggcttcagagagaatagattataaatgtttcttatcagactatgttgatgttaatgctgaagaggcctaatgaggcatgtctgacccccacttcctgtcatggcctggaccagtctctcaggttaaattttaaagtgccctggcctaggaagaagtccattcaggtggttggggggtaccttagaattttatttttggtttacagtaggcagaggaggataaagagaaagatggagagaaagataaagaacagtcagaatcatcagtcaacataaaatattttctctctccaaagatcatgttgaccagaaagaggtggacagagttggcagaacatatagtcaacagggttttgagaagagaggtttcagtcaactgagaggttcttatgggagaagcaagaataagtacagaaaacagagagaactaattcttacaaatatttttctgaaaatggtccaagtggtattagacaggtttggacacaggaatcttttagacataatttgaaacctccaccatggaaatattctttatttctctctgagagattggttaattatcatctaaggagtgaagcctttgggggcttcttctagtgaggaaatagtgcaggacaaagtgagtgagttcatcagatgtcttgtataaaaactgacagtttattttccaattctctggctgtttacgataaagtcagacatctcagagcacagggtactttagtttgggaccccttgtttttggtttaaaatttataccgcaaggtcctcttggtcctcgtagatgttgtagctgtaaagacacccaactgtttgccttttgtaaggagttttcccactgtgcccactgtaactctaagttactctgagttcacccatttctctagaaaaacacaggttctatatccataattcttatacatgaaatttgctagagttccacatggaggagttctagattttttggatccagatgaacccatgatttcctatcatattctagtaaccttacctacctattgaacccagtccagtttctgtctgacccaggcagacacctgtggcacccccatacagtacccattcctgtttctattgtgacttctgaatccattgtggatttaaaaaaatgctaaaataaatttgagagctcaagcaacaaatttgtggagcccagaatctgagagagaaatcacccatgaccccagttgctctaatagatcagtgggcataatgggctctgttgggtacttttacttagtcactcagtgttactgggggtcactggagttctactttggatccgacttccgatgccaatctgttaaaagaaaaactttagacaaactaaatttaacagagtttaattgaggaaagaatgattcacaaattgggcagccctcaaaaccagaacaggttaacagaactcttgcatgcagcatttatggacgaaaaactgagtgccctaagagagacagcttgattggttacagctctgcctttgccttatttgagcatggtgtaatcagttagctacctgcagttgaccgaagcttggctgctgtgattggtggacactcagctatttgttacaaaagtatactgtgaagttgggcttttggttagtttttatgtacgtaggttttagttcatcagttcattaggtaaggactcaagtatggaggcttcacacatgtatgaggagctgtgctggaactggggctataacagtgattagaggtagatttactataaagtgaatgaagcttaaattccaaggcccttcacttgcagggacatcttctacggccctataactaattttgtatttgtaatttggtattattgttcttgaagaaaattctgcaactcatatattttaagtccaacaaaacctgtatctggctaggaagaaaacaaagttcctgttacctgctcccattttgatgggagctggggtgggggcagacaaaaaatataaaaaatagatctataatatatcaggtggaagcaaatataggagaaacttagagcaaggaaagggatgtataaaaagtgaggggtgggagttgctgtctcacttatgtggtcaagaaatacctctgtgatatagcaagacccagaagaaatgaaggataacatcatgcagataattgggagaagaaccaactggatagagaaaatagcatgtgcaaaggtcctgagtctagaatgtgttcttggtgtgtttgaggaatggcaaagttgtcaatgtagcagaaacagtaagaaatgaagtctgagatcatgatggttcactgggctttccatcagcttaaaactctttcacagatgctgctgtgtttatttaattgtaagtttggacctttgtgaaaggctttttatttgtttatgttatttttcattgtgtatctaacagccagtatagtctgttaattcctaattctgaccattcaaatatcagtacccttgtgtgcttcagaccatctgcagattcagtcaactatatgctttctgtttggttttcaaaccatcagtggaaatcttgaaggatatgtggccttttagcatttggctagggaccattgattgacatttaatctttcagtcagtcttgagtatggtctttgaaatgtttacaagttctctcagctctaatgtggcacatcagttttgactctataaagctattctgagacaccgtcaaatactttcctaaactcaggatataaaaacagttatagcactcacctgataacttttatatcaaaagtaaaggaaggaagaaagggaggggagggtgaacgagtttttttcctaatgaacccatactagctcctagtgtccactgatttctctttgctttaaactgttttcagcattatttttttctctttttaaagagggggcatctcaggctggctttgaatttttggactctagagatcctctcacctcaacctccagaggaactgggactataggcatgggccatcactcctgtctatgtccccagcattttaaactgatgttgttattaagaaaattgtagattcttttttttttcttgtaaatttgtttgagttcattgtacattctggatattagccctttgtcagatgagtagattgcaaaaattttctcccattctgtaggttgcctgttcactctaatagtagtttcttttgctgtgcagaagctcttgagtttaattagatcccatttgtcaattttggcttttgttgccattgcttttggtgttttatacttgaagtccttgcccatgcctatgtcctgaatggtattgcctaggtcttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgttgcctttagtatagtttgaagtcaggtagtgtgatgcctccagctttgttcttttggcgtaggattgacttggcaatgcgggctcttttttggttccatatgaactttagttttttccaattctgtgaagagagtcattggtaaattgatggggatggcattgaatccataaattaccttaggcagtatagccattttcacgatattaattcttcctacccatgagcatggaatgttcttccatttgtttgtatcctctttgatttcattgagcagtggcttgtagttctccttgaagaggtccttcacatcccttgtaagttggattcctaggcattttattctctttgaagcaattgtgaatgggagttcactcatgatttggctctcttgtttgtctgttattggtgtataagaatgcttgtgatttttgcacattgattttgtatcctgagactttgctgaagttgcctatcagcttaaggagattttgggctgagaagatggggttttctagatatacaatcatgtcatctgcaaacagggacaatttgacttcctcttttcctaattgaatactctttatttccttctcctgcctgattgccctggccagaacttccaacactatgttgaataggagtggtgagagagggcatcgctgtcttgtgccagttttcaaagggaatgcttccagtttttgcccattcagtatgatattggctgtgggtttgtcatagatagctcttattattttgagatacgtcccatcaatacctaacttattgagagtttttagcatgaagggttgttgaattttgtcaaaggccttttctgcatccattgagataatcacgtggtttttgtctttggttctgtttatatgctggattatgtttattgatttgtctatgttgaaccagccttgcatcccagggatgaagcccacttgatcatggtggataagctttttgatgtgctgctggattcagtttgccagtattttattgaggatttttgcatcgatgtacatcagggatattggtctaaaattctcttttttggttgtgtctccgccaggctttggtatcaggatgatgctgacctcataaaatgagttagggaggattccctctttttctattgattggaatagtttcagaaggaatggtaccagctcctccttgtacctctggtagaattcggctgtgaatgcttgtggtcctggactttttttggttggtaggctattaattattgcctcaatttcagatcctgttattggtctattcagagattcaacttcttcctggtttagtcttgagagagtgtatgtgtcgaggaatttatccatttcttctagattttctagtttatttgcgtagaggtgtttatagtattctctgatggtagtttgtatttctgtgggatcgatggtgatatcccctttatcattttttattgcgtctatttgattcttctctcttctcttctttattagtcttgctagcagtctatcaattttgttgatcttttcaaaaaaccagctcctggattcattgatttttttgaagggttttttgtgtctctatttccttcagttctgctctgatcttagttatttcttgcctgctgctagcttttgaatgtgtttgctcttgcttctctagttcttttaattgtgatgttagagtgtcaattttagatctttcctgctttctcttgtgggcatttagtgctgtaaatttccctctacacactgctttgaatgtgtcccagagattctggtatgttttgtctttgttctcgttggtttcaaagaacatctttatttttgccttcatttcattatgtatccagtagtcattcattcggagtaattataaatggtaatgtgtctttaattttggtttccacatgttaattattagtatatatagatgcagttcatatttgtctcttgacattggaccttaaacaaccccatcaaaaagtgggcgaaggatatgaacagacacttctcaaaagaagacatttatgcagccaaaagacacatgagaaaatgctcatcatcactggccatcagaaaaatgcaaatcaaaaccacaatgagataccatctcacaccaattagaatggcgatcattaaaaagtcaggaaacaacaggcgctggagaggatgtggagaaataggaacacttttacactgttggtgggactgtaaactagttcaaccattgtggaagtcagtgtggtgattcctcagggatctataactagaaataccatttgacccagccatcccattactgggtatatacccaaagcattataaaccatgctgctgtaaagacacatgcacatgcatgtttattgcggcactattcacaatagcaaagacttggaaccaacccaaatgtccaacaatgatagactggattaaggaaatgtgccacatatacaccatggaatactatgcagccataaaaaaatgatgagttcatgtcctttgtagggacatggatgaagctggaaaccatcattctcagcaaactattgcagggacaaaaaaaccaaacagtgcatgttctcactcataggtgggaattgaacaatgagaacacatggacacaggaaggggaacatcacacaccggggcctgttgtagggtggggggaggggaagggatagcattaggagatatacctaatgttaaatgacgagttaatgggtgcaacacaccaacatggcacatgtatacatacgtaacaaacctgcacgttgtgcacatgtaccctaaaacttaaagtatattttaaaaagaggaaaattgtagattcacagcaattttcagaaataatacggagagctcctttgtatgctctagtttccgctaatggtaacagtttacagaactatagtataatatcatgaccaggaattgacattggtacaatctacccatcttattcatatttcttcagatttacttgtagtcgtatacaatcttatctgtgtagccttgtgtatctactaccacagttgagatacagaacagttccaacatcaaaaggatcccttgttttgtccttttataaacacacccgctgcctccttgtgtaccctccctttaccccatgtctaacccctggcaaccactaatctcctgtttctacagttttgtcatttctaaaatgtcatataaatggaatcatatggtatgtacactttggggatttactttttttcacttagcatagtccccttggaatccatccaaattgttgtgtgtattaatagtttgttcctttttattgctgagtaatgtttcattgtgtggatgaactgtagtttgtttaaccagtcacctgttgaaggacatcaaggcttattccagtttttggcaattacaaagaaagctgccatgaacatttgtgtgtaggtttttgtttgaacatgtttttatttttctgggataaatgcctaagaatccagttgctgggtcgtattatagttgcatgtttagttttttttttttttccaagaaactgccaaactatttacaataatttataattttactttatacaaaatttataattttactttaccatagtggcagtactattttacattcccaccatgaatggttctctttctccacattcttgccagcatttggcactgtcactatttttaatattagccatttggataggtgtgtagtagtgtatcatagtaattttaattttaatttccctgatggctaataatattgaacatcttttcatgtattgatctgcaatctctgtgtcctctttagttaagtgtctcttcatgtcttttgttttatttttagtttactcttgagttttgagagttctttatatattctagatataagttcattttcaaatatgtggtttggaaatattttctcgtagtctataagcttatctttttgttgtgctcacataggctttcacagagcaagggttttaaattttggtaaggtccaatttatcaattttttcttttatagatcatactttttgtgtcaagtctaagaactctttgcctcaccctagttcccaaagattttctcctgtttttaaaaaaggttttataattttacttttatatttaagtctatgatacattttgagttaacttttatataaattgtgaagattatttcagggttactttacttgcctggggatatccaattgctccagcatcatttgttgaaaaggctatgcttcctccattgaattgggtttgactttagtcatgcatatttatatgaacatatttttgagttctctgttttgtctcatggagctgtatgtctaccctccactaataccatgctgttttgattacggtagctatatatgttaagtgttaatatgtgctagagtgattccttctcctttttttctcttttccagggttgttctacctattctggggcctgtgcctttccatataacttaaaataagcttgcctatgtctacaaaaatccttgttaggatttttataggaattatagtaaacctgtggatcaatatggggaaaattgacatctttacaatgttgtcttccaatcaatgaacacaatatatctatctatttaggtcttttaaaaattcctttcaacccatttttttttttttttttttactttttgtaacttttattttaggttcaggagtacatgtgcaggtttgttatacaggtaaactcatgtcacaggagtttgttgtacagattattttgtcacccaggtactaagcctagtacgcaagagttatttttttctgatcctctccctcttctcaccctccatcctcaagtaggccccagtgtctaacattcccctctttgtgtccgtgtgttctcatcatttagctcccacttatacgtgagaatatgcagtatttggctttctgttcctgcattaatgtgctaaggataatggcctcaagctccatccatgttcctacaaaggacatgatttcattctttttaatggttgcataatattccatggtatatatgtaccacattttctttgaccagtttgctattgatggacatttacattgattccatgtctttgctattgtgagtagtgctgcagtgaacatacgccacatgcatgtgtctttatggtagaatgatttatattcctttgggtatttgcccaataatgagattgctgggtcaaatggtagttctttgaggaattgccacactgtttttcacaatagttgaactaatttattctcccactaacagtgtataagcattctcttttctttgcaacctctccagcatctgttatttttgactttctagtagtagtcattttgactggtgtgagatggtatctcattgtggttttgatttgcatttttctaatgatcagtgatattgagtttttttttcatgtgcttgttggctgcatgtatatattcttttgaaaagtgtctgttcatgtcctttgcctactttttaatgggtttgttttcttgtagatttcagttcctcatagatgctggatattagacctttgtcagatgcatagtttacacatattttctcctattctatgggttatttgtttaatctgctgatagtttcttttgctgtacagaagctctttaattagatcccatttgtccatttttgcttttgttgcaatcgcttttggcatcttcatcatgaaatctttgcctgtgcctatatcctgagtggtattgcctagattttcttctagggtttttatagtttggggttttacatttcagtctttactcgttcttgagttaacttttgtatatgttgtaaggaagggatccagtttcaatcttttgcatatggctagcctgttttcccagcacctttattgaatagagggattcctttcaccattgcttgtttttgttgactttgtcaaagatcagatagttgtaggtgtgtggctttatttctaggctctctattctgttccattgatctatgcatctgttttgttccattaccatgctgttttggttactgtcaccctgtaatatagtttaaagtcaggtaatatgatgccttcagcttattttttttttttccttaggattgccttggctacttgggctgttatttggttccatatgaattttaaaatagttttttctagttctgtgaagaatgtcattgatagtttgataggaatagcattgaatctctaaattgctttgggcagtatggccattttaatgatattgattcttcttatccatgagcatggaatggttttacatttgtttgtgtctttcctgatgtctttgagcagtgttttgtaattctcattgatctttcacctccctggttagctgtattcctaggtattttattcgttttgtaacagttgtgaatgggattgcattcctgatttggctctctgcttggctattgttgatgtataggaatgttagtgatttttgtacactgattttgtatcctgaaactttgctgaagttgtctatcagctgaaggagcttttgggccaagactgtggggttttctgggtatagaatcatgtcatcagcaaacagggatagtttgacttcctctcttactatttggatgccctttatttctgtctcttgtgtgattgctctggctaggacctacaataccatgttggataggagtggtgagaaagggcatccttgtcttgtgctggttttcaaggggaatgcttccagcttttgcccattcaatatgatgttgtctgtgggtttgtcataaatggcttttattattttgaggtatgtcccttcaatacctaggttattgagagtttttaacatgaagggattcaacagcattttataatgttcagtatatacagcctgtatgtgttttgttaggtatctacctaagtactctattttcttcagtgctattgtaactggtattatattttaaattttagtttctgcatgtttattgtcagtatatagaaaagcaattgaatatttgtgtgttgatcttttatctgtgtacttggtgatatggttcgggtctgtgtcacctcccaaatctcatgtcaaattgttttttttttttttttcgagatggagtcttgctctgtcacccaggctggagtgcagtggcacgatctcagctcattgcaagctctgcctcccaggttcacaccattctcctgcctcagcctcccaagtagctgggactacaggtgcccaccaccatgcctggctaattttttgtatttttagtagagacagggtttcactgtgttagccaggatagtcttgatctcctgacctcctgatccaccctccttggcctcccaaagtgctgggattacaggtgtgagccaccatgcctggccaatctcatgtcaaattgtaatccccaatgttggaggtggggcctggtaggaagtgattggatcctgggggcagatttctcttttggtgctgtttatgtgatagtgagttatcatgagatatggttgtttaaaagtgtgtagcatgtccccacttttctctcttcctcgtgttctggccatgtaaaatgtgcctgcttccccttcaccttctgccgtgattggcctccccagaagccgtcaacgtttcctatacaaccagtggaactatgagccaattaaacctcttttctttataaattacccagtctcaggtacttctttataccagtgtgagaatggactaatacacttggtaaactcacttatagattctaagtgtttttctgtagtttccttgggatcttcaacgtagacatagcatctgcaaacaaagatagttttctttctttctttctttctttctaacctgtatgccttttttttcttgtcttattgcactagctagtacttctagtactgtgtttagtattgagaacaactattcttgccttgttcctatcttaaggaaaaaatactcagattttaccattaagtatgatgttacctgtaggactttgtagatgctttttatcaagtgagttaatttttctctatttcaaattactgagagtttttttttcatgattgagtgttggactttgtcagataccttttctgcattgattgatatgatcatatgatttttcttcttcatcttgttgattattgtgaattacattgattgatttttgaatgttaagccagccttgcatacctggaataaaccccacttgttcatgatgtataattcttttcatatattttggatccagtttgctaatatttttatgaggatttttgtatttaagttcatgaacaattattggtccttagtttccttttttaaattatattttctttgtctggttttggtatgaagataacactacccttataaaatgagttaggaagtattaccttcttcctatttttctggaagaaatttgttaaagtttatgttaattcctctttaatgattggtggaattcaccagtgaattcagttgagcctgaagatttctttttcaggagcttttaaattacagattgaattattttgatagttacaagtctactcagattatctatttcatcttggttgaggcttggtaggttgttgtttctgaggaattggtccatttcttctcagttatcaaatttatgagcataaagttattcatagtatgcccttatatttttaatggttgtaggatctagtgatatattctgtttcattcctgacattgataatttgcatcttttttctttttgtcagtgttgttagagttttgtcaattgtattgttttttttttccctaaggaactagttttttattttattgattttcttttttattgcataagactgaattatttaaaaatgttttcctcatagtttctttataatgcatgtaactgtttaacacattttaaaaaaaaatttcaatagctttaagggtacaagtgatttttggttacatggatgaattgtatagtgatgaagtctgagcttttagtgtacctgtcacctgaatagtgtctacattgtacccaacaggtaatttttcatcccttaccactctctcaccctccccacttctgagtctccaatgttcattataccactctgcatacccctgtgtatcaatggcttaacttccacttataagtgagaacatgcggcatttgtttttccattcctgagttacttcatttaggataatggcctccagttccatccaagttgctgcaaaagacattattttgttcttctttatggctgaggagtattccgttatacacacacacacacacacacacacacaccacattttctttctttttttttttgaaatggagtttcactctgttgcgcagcctggagtgcaatggcatgatttcggctcactgcaacctctgcctcccaggttcaagcaagtctcctgcctcaggctcctgagtagctgggactacaggtgtgcaccaccacgcctggctaatttttgtatttttagtagggatggggtttcaccatgttggttaggctcgtctcgaactcctgacctcataatccgcctgcctcggcctcccaaagcgcagggattacaggtgtgagccaccgtgcccggccaccacattttctttatctactcacccactgatgggcacttaggttggttctatatttttgcaattgtgaattgtactgcagtaaacatgcagttgatgtttgtatggtgtattttttcattttattatttgcagttgtttactttgaacactttgaaaaatattgtgccctttctattggcctttacaatttcagaacagaaattcttggccttttgaattgatgttccctattagtaatatgcgtttatttctttttattttttagatttcaaaattttaattatggtgtgtcttagcatggatttctttgagtttatcccacttgaagttgactcagtttcctgggtgtgtatcttttaccaaattttggaaactttcaaccattatttttttgaatattcattttgtcccacatcctttcacctctctttctgggactccaatgatatgagtattagatcttttttcattgacccacaggtcatgttttttacatctgtactttccctgtttttcagattgggtgaattccactgtgttctctcctccagttcactgattctatcctttgtcatctccattgtactattgagtcctccagcaatcttattttaaaagtttctgccattattttctcagttatagagtttccatttggttccttttttaataatttctatttctttgctgcatttttcctttttcatctgtttcaagataatttgtaattgattgcagaaacattgttataatagctgctttcaaatgttgttaaataattctaacatctgatttcatcccagtgttgatcttagttgattgtcttttcttcttcaagttgttattgtcttgtttcttggtatgatgggtgattttttttattgtatcatagatgttttgtctatcatgttaggtgactttggatctcatttaaatcttttattttagcagtcaccttgtttaggtttagcctgtgagttgtgggcctacttttgtgggttgtggttccagtggcagtttaattttcatagcttttgtggtgttattttggtttgcttggtttatctggtgctgctggggcttccactgctcctgctggtggtgcttgacggggcagaaggggtttcccaaggcctaccattgattgtctctggaagaaggaagggcatggtgggattctccaccagtgttccccactctagtcttcctccaaaagtgtttgggcaaaggaggagagtcttgggtttgtgagataaagaagcttctaagaactggtgcttcttctgactcaagtgccatctctggttccgttttctttcctaacgtgtttgagtgtagatggaatattttgaatccatagggataaagaggcttctcagagcaggctgcctgcttcagctgggtctctcctataggttcagccttgtcagcctcagtatgtcttgggggcaaagggaagctcaggcctggtggggaaagagagtacttcccctgtctgctcattgctggttgggctcccaattgatccaccgtgctggtgacattgggctcacctgatgttgtcagaagactcccatttgatttaggagaggaatgagcccacgtgggctgatctctgttgctaagataggggattcacaaacaccaggtctaggtggtctttctctgtggagtatggggatgcaagatatcccatagctttgctgttcttccattctaaaccaactcatcttcttgttatcactctcatagtttcctttggttgtctcttatgtcatttccaggttttatagttgtgtttagctgagagaagcagggaaaacaccatcctgcccaaactggaagtctttttaataatgtattctataaaacctatctagaattgaggttacattcaccagcttgtagacatgactttctttttaaaaaaaatcaagactacatttgcctctctctagacttctgcacctctctcattattcacaattctgtgtagatattagtttggaaatcttagtgtaagatctttccagtatcctggaacttatcctaggacgagtgcttcttaatcttttcttctgtctctctgttttcatctttcttcaactcatgttttctgtaccctttcttgtccttcttttcttttcttttttatttttatttatttattttttgagacagagtcttgttctgtcgcccaggctggagtgcagtggtgctatctctgctcactgcaagctccacctcccaggttcatgccattctcctgcctcagcctcccgagtagcttggactacaggtgcccaccaccacgcctggctcatttttttgtatttttagtagagacggggtttcaccttgttagccaggatggtctcgatctcctgacctcgtgatctgcccgcctcagcctcctaaagtatcttttctttaaatagaggaaaagtggaaataaaataggaatatttttctttctctttgttacctaatgttagttttctggttactgattgcaatttgaaatccctttttgttatcctcagaatatatctctttttaaggctcacatcattctgaatcttggccttttgggtgttttgcaggctcatgacactcttgtagttatcactggttatgtctatttcattacactagtagagctatgaataccaacttaagagtcagacagacttgcatttgaatctcacctctgcctctttctatgtgtgtgatttgggattggttgtttaacctctaagctattatttcctcatctataaaatggaaacaatagtactattaataataggaccaactttgtagggtttttataaggattaaatgaaataatatacattaatcatgtagcaccattccttacatagagtaaattaaatgccattgttgttatatatttttaaaatctgagattatagaaacacgttatagctttcttttgatacttatctttttctccatctttataattgtacagtcataacttcacctttgagtgccttccagtagcttatataaattaaagttctcaaggaagaaggttacatatcttttaaattgtgaaatttcacctaatttaattgcaactggcattcttaatgcagtttctggtgatggtcctcttactgagtagtaaacgcaaatatttcacatgcaattggtgtgtaggtgttaaattagcctttctggttaaccatccataaatatttcaaaatacttaccttgtgtgggtacccagcttgcttctacatgctacaaaagtttttgcttgtttgacattatcatatgtcctacctgtatttcttgctgtattttaaaataagttcacagttatagaacatcagcatacatccctggtgaaaaatgaagtttatgagtcacttagtaacttgaactttctgaacaggaatcatatctaattttatattttgtatagtgcccaacccattcaggtctttatcactaacaattgtacctaaaatgatgcagcaattgtatgaaggtcagcaaactgacatcattatgagtgtattctaactaacctaattcttccagtgtgtttttcctctgagttaaagttggtaatctttttaatcttggtaaattctttaggtttcatgtttggtagctataattctggaacctcccaaaactatcttaattagaggcatgttagaatgtgtttgaatgttttctgctgtagtttggttacttctgggcagtattatgtaatcttaagatgtgttttcttcaggaattcaacctttcccgctttctttcacctattatttttagcactccaccccctcctctgggaagaataggaatccaaattgttgttagtctcctggagatgcatagaactagggtcttgctaactctaacctttgagtgttctagattgcttttgagggccatccttggtgttatggtcaaattgtaacttggataatttagattctcataacagaaatataattgaaatggcacaaggtctagtattttccttcttgatgtcatgaaatggtgctgtgcattggtgaggtacctggctttctccatgatgttccattggtgaattgattactaggtttggtttgtttatatgcttgtaaagtgttattgagtcctttgggggaatcaattaattagtggtggttgggttgctttatgttccactatagaattgtacccttgccagaagaaatatagatgaaagtgactgagtccttgggcctgatttggagttgacccttttccacgctttcctggcctactgctatttccaagtctctttctttaggccattctataactttgctttttcttttttttaagaaacatattctggcttccctttgtacagaaccctcttccttagactgcttccacagtgtaccaagtgtctggaatgccctctcctttgtctgccaaaccatttctctgctgtaagcttgagagtgctagaaatctcacctccttcgttaaactctgttgacctaagtgtcatagaagtgacagttccctgaggctcagatcatgtaaacacttctccctgtcagtttatgtagatgttcagtgttttatactcctattttaggtatctttgtgggatggttatctgtgttgtctggtatcttagatttttaaatccacaaaggggagaaatcctatcagacttactgagtattcagtcacgcaagtaactaggcatttaatgtactgttctttgatggcagtgtcattgaggaaaaaagtgaacaaattacttctgtgaaaaattaaaactcttgctgcttgttgaactttctaataaataactgagcttataggcttaggaaatgggattgggatgttcaacgtttcaattcttggccacatagtatctactataatgttttagaagttttatttctctttcctccatactagtcagataactcaaatatttgacttcatcgcttagtaatctttgtatgcattataatgctgcctttcagtttacatgccattaactagagaagtcttaaatttctattgttaaattctccacagatctgactgaacgtgtggtggatttctacctctgggaatgcgattatttattaactgccttgacaaaaacttttagacagagacaaaacccttcacaattagaactctgcctgtatttcctcctttatgtcctgccataccctatcactcatctagctccaacagtaccaaagtaatagtaatttcccatgcccacagccatacctttgtacacataatgttatcttctcctgaagtgcatttttctttctctaaccccttattcatctggcatattcttgacttatctaaaatttcttctattctgtgagcattttttgacacttgtactagacaaagttagttctattttcattctcccatgtagcatcctctacacacctctagtcacacctttagttttacatacttaagcaatgtattttttgccatttgtttgtggtcctacccctatccatttcactgtaagtttcttaaagacaagaactgtttgttttcccaaagtttgaagagttattgacacatagcatgtgctcagtacttgttgaaatgaatgaatgaatgaacgaaccaaggacaggcatgtcaatggcattagaaaccatgggtatggggacttctgcttttgttttgacggactaactggtatcagaccaaccatccctcaagaaaatatagaaagactggataaaattacaaaatatctgtttaaaagcatcacagtgttaccaaagtaacagggtcaaaatcccagagagaaaggagatgtattgaggtgagcctaatagtctgtgctagatttcctttgaaggcattttccagtgtaagtgatatgggtaaagagactgagaagccaaactgaaagtggtaactaagagacagataagatgagcaggggtttcagcggtctcacagggctgtagagataaaaagtgaagttcagctatatcctgacagtcagaacttgagggtctaagatgccagagaaaaggaaagtacagtgagtttagttcagtattttacactattttttcctttgaggaattggctgatttataagtggtacaaggcaaaaaagttgagaagttaagcagagagtggcagatacaatgcttagtagttaagcagagctttcatcaatttcacaatgctgaagagacagaaattagagttcagagcctgccaaagaggagggaccctggtaattattccaggttttcagtttggatccccaaagggctaaactctaggagtaaggatgaactagaaaataccatttttcacaaagactgaagtggagctttgaatcagctcaaccttagcaggattaatgtgatctgtccttcaccacctgccaaaagcaaaagtaaatctttggaggaagataatatcatccagtgctcctctaacttttaatatataatgtctggcattcaataaaaatattacttggcttaccaggtatgttagtttgctaaggctgttgtaacaaagtaccatagattgggtggcttaaacaatagaactttattgttttacagttctagaggctggaaagtccaagatcaaggttctagaagatttggagtctggtgaaggtgaaacgggagagttccctgactcccttgcaggacttgtgatgggtgtggctcacttgccacacgttcaaaccccttacaggagcgggagcacacggacaggcaggtgcacaagcctgggcgagtgcttttgggctctggccccatggtagcatccacgggtgtgttacaattaatgctcttttagcagttgccatctgcagacggctacgtgttaaaccagctcagtggagagtcagaatggcagtgttttacactctgtgctcttggtacctgggctcttttctggcgttcaagaagaatcaggtcacactgacttgatgaatggtgaatgcgggtattttattgagtggtggagtggctctcagcaggatggatggggagctgaaaaaggggtggggttagaagatgaacttcccccagagttcggctgtccgcagtgaactcctctcgacgactttcagatgctctttctcttttctccttctctgctgcactctgctgctcatctgctcatctgctcgtggagcctgaggtttggggtttatatgggtacaggatgggggttgtggagggccaaacggcaacatttgagcatgaaaacaggactacctattcccatttagggctgtggatttccaggcttgaggatggggcctttgccagggaactgccctctactacccagtatttccctgcctcctgtttggatcaaaggcataatttctttgatttatggttggccattctcctgctgtgttctcacatggcagaagggagaatggaaatctctggggtctctttataagggaactaattccatttatgagggctctgccctcatgacctaatcaccttccaaaggccctaacttcctaataccattgcattaggggttaggatttcaacatgtgaattttgaggggcacttgctgtactgtaccatctcctttcaggcctcatttcaccatccttgtctaaacttaaatctgcatctttaagattgctgaggttttctgttttgtgttgcttgttttttcctattcctaaagcatttaatagaaatagatcttgtttgggtgtgttaaagaatttgtattttgtgcttttgtcagcttacatttttggtttgttgctgtttctaaccccttctcttctattgtcaagtcatttaaccaatattttttgatgtactatgtgccaggccctgtgctaaatgattgtgataaaaaatgagtaataggctgggcgtggtggctcatgcctataatctcagcactttgggaggcggaggtgggcggatcacttgaggtcaggagttcaagaccagcctggccaacatggtgaaaccccttctctactaaaaatacaaaaattagctgggcatggtggcgcatgcctgtagtcccagctactcgggaggctgacgtgggagaatcacttgaacaaggaggcggaggtttcggtgagctgtcatcacaccactgcactccagcctgggcggcagagtgagactccatctcaaaaaaaaaaaaaatgagtaatagctagtggggaacttagacacttaaacatttttgatatggtaaggtgaatgttgtaggggaatcatacgaacacagaagagtggttacttctgcctatggtgccacctagaaggtgacatttgagctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaactctcctgctcaccatccctgtttgacattttatgctgctttatttttctttatatcatttatcactactttatattctttccatttatttattcatttgttttttaatttttaaaatttttttgtggagacattgtcttactatgttgcccaggccagtctcgagctcctgacctcaaatgatcctcctgcctcagcctcccaaagtgctgggattacaggtgtgagctactgcaccagcctatttatttgtttattgtatgttcttccttttgaatgagagggtctttgaggatggggattttgttttgttcactgctgtatccacagaagtgctcagtgtattaggtgctcaatatttctgaatgaacaaatgaattaatcagggaatccatcctggaggagatgaaccttgacaaggcttctcaaagcatgaagggccatgacttggtagaaaagaagggaagagctaagggcattatatacacaagcagtgtcatttaccaagacagggatgtaagtatgagctcctgaagtctggggacagtaagcatgttgtcttactactatgaatgacagctaagatgtgaatggaggtagaagtataatgttcttgcatattaaatcctttctagtcttcagaccttcaaaccctacctctctgaggcctcatttgactccacaagttttactttcacaatgaaacttgttagttccttggggacaaggaccttggtttagccttttgtacccaatagatgcttaaaatgcgtgtgtttgatttggcaaaggaaaattgctcagtgctgtgctttagtaaataaaagaatctaccttttgtgaccataatgaaaaatatgcattacacttagcttattatcttcattgctttatgtaagatagtactactgaacaaatattaatccgcagacagcaattttctgcttttatcctgggaagatactcacatatgtcagacgttatcaaattgttcacttaaaattggtgaattttattattcattaattctttttaaaatatttgatagaattcttcagtgaaaccatgtcaacctgaaattttatttgttggatagtttatacatacaacttatttagtagatatagaactgttcaggatatctgtttcttcttgaatgagtttagttattttgtatctttcaaagaattggactgttttattgcttatttttatatagagagtttttcatggtattccactgttgtctttttaatgtctgtagggtatgttgtattagcctcactttcattcttcagattagtaatttgtgtcttcttacctttttttcttggtctgtgtggttaaaggcttatcaattacattgatattttcaaagaaccagctattggcttcattgacacttctcaatttaaaacaaaaattattttatcatgcttactttggcttaatttgctattcttttccaattttattaagctgaatgagtaggttatgaattgaagcctttattctttttcttttttttttcttttttttgagatggtgtctcattctgtcgcccaggctggagtacagtagcgtgatctcggctcactgcaacctccgcctcccgggttcaagcaattatcctgcctcaacctcctgagtagctgagattacaggcgcatgccactatgcatagctaatttttgtatttttagtagagatggggtttcaccatgttggccaggctggtctcaaactcctgacctcaggctatctgcctgcctttggcctcccaaagtgctggattacaggtgtgagccacctttattctcttttctaacataagcatttaatactataaatgtcccctaagcactgctacagctgttgaatagcggtggtgagagtcaatatccttgttctgttcttaaccttaggggaaaaacattaaatctttcgccattaaatatcatgttagctgtagatttttcatagatgctcttgatcagattaaggcagttgcctcccattcctaatttattgaaactttttttttatgaagattagatgttgaattttgcctaatatattttttgtgccttttgagatgaccatctgcatttccttctttattctgttgacatggtaatctgttacattgattaattattaaatattttattgaagatttatttatttattttattatacttttaagttctagggtacatgtgcacaacgtgcaggtttgttacatatgtatacatgtgccatgttggtgtgctgcacccattaactcgtcatttacattaggtatatgtcctaatgctataatttcccccttccaccaccccacaacaggccccagtgtgtgatgttccccaccctgtgtccaagtgttctcatttttcaattcccacctatgagtgagtacatgcagtgtttagttttctgtccttgcagtagtttgctcagaatgatggtttccagcttcatccatgtccctacaaaggacatgaactcatccttttttatggctgcatagtattccgtggtgtatatgtgccacattttcttatgcagtctatcattgttcaacatttgtgttggttccaagtctttgctgttgtgaatagtgccacaataaacatacatgtgcatgtgtctttatagtagcatgatttataatcctttgggtatgtacccagtaatgggatggctgggtcaaatggtatttctagttctagatccttgaggaatcgccacactgtcttccacaatggttgaaccagtttacagtcccaccaacagtgtaaaagtgttcctatttctccacatcctctccagcacctgttgtttcctgactttttaatgatcgccattctaactagtgtgagatggtatctcattgtgattttgatttgcatttctctaatggccagtgataatgagcatttcttcatgtgtcttttggctgcataaatgtcttcttttgagaagtgtctgttcatatcctttgcccactttttgatggggttgtttgattttttcttgtaaatttgtttaaattcttcatagattctggatattagccctttgtcagatgggtagattgtaaaaattttctcccactctgtaggttgcctcttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttccaggggttttatggttttaggtctaacatttaagtctttaatccatcttgtattaatttttgtataaggtgtaaggaagggatccagtttcaggtttctacatatggctagccagttttcccagcaccatttattaaacagggaatcctttccccatttcttgttttttgtcaggtttgtcaaagatcagatgattgtagatgtgtggtattatttctgagggctctgttctattccgttggtctatatctctgttttggtaccagtaccatgctgttttggttactgtggccttgtagtatagtttgaagtcaggtagcatgatgcctccagctttgttctttttgcttaggattgtcttggcaatgcgggctcttttttggttccatatgaactttaaagtagttttttccaattctgtgaagaaagtcattggtaacttgatggggatggcattgaatctttaaattaccttggacagtatggccattttcatgatattgattcttcctatccatgagcatggaatgttcttccatttgtttgtgtcctcttttatttcactgagcagtggtttgtcgttctccttgaagaggtccttcacatcccttgtaagttggattcctaggtattttattctctttgaagatttttacatattaatgagagatattggtctgaaatttttttgttgtaatatttttgcttttttttttatcaaggtaataatcgcttcatataaaatgagttgggaagttttttcttctcttgtatttcctgaaagtttgtggaaaattggtattatttctttcttaaatgtttggtgtaatttgccagtgaagtcatatggggttggagggcttttgttcttgttggaaggtttttaacaaaaagtattttaaaatagatatgagattattcagattatctatttttttcttcagtgagcttttataatttgtgtctctcaagaaatttgtccatttgtctgagttgtcaaatacatggacacagtgttatttgtagtattctcttattatcttttaaatttctgtggggtcaagaatgatgcctctcttctattcctggtatagataatttgtgtcttctgttttcttggtcagtctagctatagatttatcaatttttttggtcttttcataggaccagcttgtgatttgattaaaaacaggtaaaaaacagaaacaaacattttttattgatttccgtttttatttatttcttttctcctccttgctttgtgtttaatttgctcttctttctttagtgttttcagtagggaggttagatgactaatgttagtctttctattctgatataagcatttgatgctgtcatttttttctgtcagcactgctttaactatatccaaaaaattttggtatgttgaattttcattttcattcagatcaaaatattttaaaatttctcttgagaattcttctttgattcatgagttattgagatagatattgtttaatttccaagcatttggaaattaaagcctattttatgtttactgatttctagtttaatttcattgtgttagagaacatactctgtataatttcaactcctaaaaaactttgtcacacccattaggatgattactgttttttaagaaacacagaaaatagcatgtgttggtgaggatgtggaggaattggaacccttctgcattgttggtaggattctaaaatggtgcaaccattatggaaaacaggaagggggttcctcaaaaatttaaaaatagagctaccctatgatccagcaatcccacttctgagaatacatccaaaagaattgaaagcaaggtcttgaagggctgtttacacacctatgttcataccggcattatttacaatagtcaagaggtgaaaacaacccaagtgttcattgacagatgaatgaataaacaaaatggtgtgtttgtatgtatacacacatgcatacacatacaacagaatattttgtatgtgtatatacacatacaacagaatattttgtatgtgtatatacacatacaaatggcatatttataatggtataacaatggtgaatatatatacacacacacattcagtggaatattatttagccttaaaagggaaggctgtgactcctgtcatatgctacagcatggatgggctttgaaggtattaggctaagtaaaagaaactagtcacaaaaagacaaatactatttgttctgtcgtttaattgtttgttttctgattgtcccctctagtctttgttcctctctttcccattttctgttttcttttgtaatattgatagtttaaatcttagttcacttctccaagcttttggtgtaattctttgcgtctgttctgtgcatgtacagcttagggctgagcacaagacttatgtggattcatacacagaattagaagatcccattctctagctctctcctctccagaattttattcatgaacccactcttgagaccatggttgccactttcccaattcccctagtcaaaaagacagggtattcttggaattttagctgcttacacagccatcagagccaatcagttccacaactagggcttttggggcaaagctgctggaaaaaacagaaaacaagaacaaaagaggattgcccccacacactctttgctcacagggaccacttttcttgtttattcttgctagtaatacagggtttctattaggattgtcaccaatcatgccactgctctgccatgcagctctgcaactggaatccacccccaggaaaatctgcaagagaaaaaaaaaaaataggctgggcgtggtggctcatgcctataatcccagcacttcaagaggctaaggtgggcggatcacctgaggtcgggagttcaagaccagcctgaccaacatggtgaaaccccatctctactaaacatacaaaattagctgggcgtggtggcgcatgctgtaatcccagctactcgggagactgaggcaggagaatcacttgaacctgggaggcggaggttgcagtgagccgagattgtgccattgcactccggcctgggcaacaagagcgaaactccgtctcaaaaaaaaaggacacccacttatgttttgtttgttttcatttttgttttttgagacagagtcttattctgtcactcagtagtggtgcgatctcggctcgctgcaacctccacctcccgggttcaagcaattctcctgtctcagcttcccgagtaggtgggattgcggacatgcaccaccatgcctggctaattctgtatttttagtagagacgaagtttctccgtgttggccaggctgctctcgaactcctggcctcatgtgattcacccaccttggcctcccaaagtgctgggattacaggcgtgagccactgcatccagctttttctctaaagttttaactccccttcaaaatctacctgtttttggttacttggcagtgttgccagttaattgatttttgtattttttttccagcagttttagttgtatcaggaggagagataggttgtagtgagcttactccaactttttttttttttttgagacagtgtctcactctgtcacccaggctggagtacagtggcgcgatcttggctcactgcaaccttagtctcctggattcaagcaattctcctgcctcagcctcctgagtagctgggattacaggcgcctgccaccatgcccggctaattttttgtatttttagtagagatgggtttcaccatgctgaccaggctggtctcgaacttctgacctcaagtgatccacccatctcggcctcccaaagtgcagggattacaggcttgagctactgtacccagccgagcttactccatcttgaccaaaactggaattcatctttttacttgtaaactccctgtatgtttatatttaatgtgagtctcttatggacaacatatagttgactttttattcagtctcacaatttctggctttaaatttggatgtttggataattttcatctaatgtaatcatggtaatgttcaggtttaaatctaccattttgctacttgtattctatttgttctatttgctctctagttctttttatcttcttttcttgccttcttttggagtaattgaattatgatttaattttatctccactgttggcttactagctatacttctttgttttcagtggttgcaccagattgtgcttattgtatcctaccttaaaataatatcatactacttcacatgtagtgtaagaaccacacaacaacacactttgattttgtctctctcatcctttgtgccattgttttcacacattttacttttacatatactataaacctcctaattattgttatttttgctttacatagttatttatcttttaagaagaattaaaaaatgattacatatctttcatatttaccatttatagtgttatttctttgtgtaaatcaaagtttgctctggtatcattgtctttctgcctgaagagcttaatttaaaatttcttgcagtgtaagtctgctggtaatgaattctctgtttttgtttgcctgaaaaggtctttttaaagagttcagctttgaaaaacaatttcactgggtgaaggattctaggctgacagatttttttttctttcatcacttcaaatatgtcactcccctgtcttttgaatagtgtagtttctgatgatatatctgtaattattcttacctttgttctgctatataatatgcctttaatttggctgcctttagcattttctctttatcactggtttaaaggaattaggttatggtatgccttagtatggttttcactgtgtttgtcttgtttgaggtttgttgacttttttgaattatcaagtttataattttcaataaattggtaaatttttggtcataatttcttcaaattattttttgcctttatgtcctttgggagttccaatgctctgttcacttattttcagtctttttctctctatgcttcattttcaatggcttctgtggcttagtctttaagtttactgatctttttctgcagtgtctaatctgttcttaatcccatctagtattcttttaaatttagatactgtatttttaatcttcagagctttcatttttttatttctgtcctggttttagttatttgattcttctgttttgtttggtgagtctagctaatttctcaattttgtagatcttttcaaagactaaacttctggttttattgattttctctattgtttttcatgatttcattaatctctgtcttaatctttattaattcctttcttctgcttgctttaggtttagtttgctctttttagagtgtcttaaggtagaaagttattgacttcagatctttcttctttttaaatatatacatttacagctgtaaacatccctttaagcactattttagttgcatctcataagttttggtatgttgtcttcatttttattcatctcaaaatattttctaatttccagtttgatttttttcattgacctattggttatttaggagtatgctacttcatttacacatatttttaatttcccaactttatttctgttattgattgctgattttattccattgtagtcagaaaacatactttgtatgatttatgttcatttaaatttattgaggattgttttatggcctagcatatggtctaacctggagaatgttccatgtgcatttcagaagaatataccttctactcttgttggatagagtgttatattgatgtctgtaaggtatatttggtttataattttgttcaagtcttctgtatcctcttggtcttctgcctagtttttctattcattactgaaagtgggatattgaagtttccaactattactgttgagttgtctgtttctttcttcaaatttgttagattttgcttcatgtattttggggtctgttgtatgtacatgatttttaattgttatgtcttcctaatgggttgatcattatatcactacataatatccctgtttatctttggtaaacattttatcttaaagtatgttttgtttgacattaatattgccactccaacatttttatggttgctgcttacatactatatcttttccattattttactttcaaccaatttgtgttttttaatctaaaatatctgtcttacagaaagcttatagtttaaccttatttttttaaaaaaagtctgataatctctgacttttgattggattgtttagtcatatttaattttattattgatgtagttggatttatatctgccactttgcttttgaccctctatatcttttgtcttctttgttcctctatttgtacttctgctttcttttgaattaaatgaatatttttctggtataacattttaattccttttatgattttttcactatatatttttaatcactttcacagtggttgctgtatggcttaccatatatgtcttaatttatcatgatctagttcattttttactagcttaatttcagtgagatatagacactttactcctaggtaggtctagtccctcctcacttttgatgcttttattgttatacacattacacacacacaaacacatatacaacacacatgcacatatatattacaaatcaagcaaaaacattgttatatgtattgccttatataatttgtatattttaaagaagctgagagaacaaagaagagcaattacatttatatagagtgtattatattaacctttatattgccttttttggttctctttattttttcctgtagattcaagttaccacttgctatcattgccttacttcagtacagcttgttctcacccacctgtgtggtgctgttattgtcaaattaatatatttctatatgtaataagcccaataattcaattatatacctattgttttgtataattaaattagttcaaagaagaaagaataaacatatacattttactgtctttctaagtgtataattacctttacaaaacactctgtgtttttctctatgggatcaaattaccaccaaggattaggcttttttagcctgaagagtttcttcagtatttcttataggtcatgtatgctagcaacacattatctgtctttgtttatataggactatctatatcatcatcatttttgaaagatatttttttctggagaaaatattcttggttgatggtgtttttttttgtttgtttcctttcattaccttgaaaatatcactctgttgccttttagcctccattgtctctaatgggaagtcagctgttaaacctattgggttcccttgtatgtgatgagttgtttttctctagttactttcaagattttaactttgtctttcagcatttctgctatgatgtgtttgggtgtagatctcattgcttttatcttacttggagtttgttgagctttttgtatttgtaggttaatatttttcaccaaatttaggatgttttttaacattattttttctaatagtttttctgcctctttctctcttgtctccctctagtactccattacatttattcagtgtatttaatggagtcctgcattgctctgaggctcttttaattattcttcattctttcttttctttcttatcttggattgcataatctgttgatctttcttcagattcactgattctttcctctgcctgtcaaatctactgttgaacccctctcatgaatttttcattttagttattatacttttcaactctacaacttccatatatatttttttctatttcatatatatagaaaatatatatgtaatatattatatgcaatttctgtgtattattgggattctgtatttgatgcggcattgttatcatagcttcctttacttctttagccatggtttcctttagttttttgaacatatttataatacttgccttgaagactttgtctaccaagtctaacacctgagcttccctaagacagtttctcttgcctactttttaaaaagctgtgtgtgagtcacactttacccattctttgcatgttttgtaattttttgttgaaaactgggaatttttgataatatagcaatctggataatatttaccaccaacacccccttccccagttcaagatttgttgttattgtttgctagttgtttagtgatttggatgtagtagttcagtgaagtctactttccctacactatgaagtctctgatgtcacctcagaaggcacaaggtttcttatgtgcacaatcaccttgggatggcattggtttttatcagggctctatttgatggtttctttttctgatctctctgttgtcagtctattggtatcatacatagtcagctattagccaacattagttgccaactggttgttctattgtttttgtcaatgtatggggcataaattgctcaatctgatccaattaaattcagcaccttttgtataggtagttttgagactagtatttgaagtttactctgattccaagacacctcttggaacacatctaagcatgtgtctttccctgattctcttacatatgtatctagctgatgtatggtttagcttgttgctgtcttaaagtaaccagccctttcttaattactcaccaccaaaatctccattgtttccacagagctctgaggtctgaacttactcatgctctgttccaaataaagtcagttccctaggggagagttttggagtcttctgttcttatggtcttcctgccccctggggaaaacatctgcattactcctccagagctggcagcttagacagtagcctgcttttcttgcagttacaccccctactttattgatgggattggcagcttttgagtttcccagcttttctctcctggtgtagaatcttgccttatgagtgagctgagataagggtatttgaggcccagtattcttggccatccatgccttgggtggaacttctgtcctacaagtggtaagtgtgtagagtcagagccatgcccacctggattagagtttatgaaacacaggtttgggtgtaggtaagaaatgttggcatcctaccctaccccgtgtgacaccgtaatcctaggctgtgagctggagggagatggaactctgtgtttttggctgtaattgcccaaagtagagtttctgttacactgatctggggaaatagagatggggtaagagaagcaggagatgaattgtgtcttaaatgtcacagactgacattgctgttaccaaaatgtagtagattttcttgaagaaatatttcttcattttctgtatgcttttaggacagtttccaaagacttttagcagttgttgcttttttataattttcacaaactgtggttgtttaactaggttgagagtctgtccagcacttcatgccactatcctggaagtcattccccatattgtttttctgacggttcttttcctcaacttttggtagctccctctcacatagatgcagatttggtaatcagccaatactcaccatgctctgttacagttttctcttcttgcctgtggcctggatagtacttctatgcagtaaactagggcaataattgggcttaccttgtttggttctgttttcttgggggtcacagtcctgtgctacctgttgtgtaatatctgaaataaatgatattttttatggctttccagttgtttaaggaagaaggataaatctggtcccttctactacatcctggctgtaagttagattcccagtccagtactcttcatctcctcttttttctttacctgattaggagctgagacttgagatttgaattctggctccccaccggttaaggcaagtcacctcatttttttcctacctcatttttctctacaaagtggaactaatacaagtacttcccttttactgtttttgtgagaattgagttaatgtttgttaagtgtttataacagaatatggccaataggaaactcaaataagttttagccactactaccaccaccatcaccactgccgccgttgctactactactactgctgctgctactactactacttcccatgtatcactggagaaattgtctaaggcattgcttatggtacagatatggaagaggactggaccataatatttagtagatactgctggattttaaacattatatagtagttggttttttgtatgtgtgaactctcatttgtttgtattaatgtgcaaacttaagatgatagaacttcagagctggaagagatcacctgtgtcaatcacgagcaaaattaggtacatagagctgattccctgggctaagatcatgtaacaagttcatctctgacttccattaagtgctgttagtgtcacaccatgataccacttgcctcttctgtatctaatgtcctcctccaccatcatccaagggaaaattgtgctaatagttctctacaattgggtaaatttaaaaattgaggtaaaaccaaagatagtgttaactgcccacatgaactcttagggtagttcaacctaggtaagtaaatgtgttcaatatccaggcattagtagaccatccatagcctgtttctatttataaagatctggaaatagttaaggtggctaattttggaaatgtatttcatttccatctggtctgaatcaatgaacttaaacttcatgctatgtgggatggagacattttatgagataccagatttaaagactattatataatgttcccagagtcttcttttggtattacaagataagtttaattatctgtgcacaagtgatatgataacagtaatatctgatgaagaagcaagtggatgcctcctgttgacttggatatccttctttgagccttcaagccttccctgtatgatgttctctgtcaggagaacagtgcatttggtgctttactttagtactcttgagcatatcaaggtgatatgatagcactggcaacctgtttctgaatatctgtgtgccaaggcattgctctaaattctaaaccctttccccacattatctcattttaatcatcacagaaacattccaaaataggtattccagttttatagaggaatgaaactgaggctcaaaacagtgaagtatcttgtccaagattatgtagaaggccaggaacagatgtggaattctgacacagagtgtctgactctgaagccccgtgtttcccataggggttatcattggaattagcactgaaatcattggtcatagtactgctactaaatgcaaagctctactactaaaacttttaaaggcaatgttgtaaagatactaccgtgtatctttgcacccagaagattaataggaggaacaagtaattaaaggtttcatgttagataagactttggtgaaagaatgcaagaagctaaagtagtactatgggcttaaacccccaaatggtatccatctattggttttaccagccagcaggtggtcttcaagaaaggaggatgttttggttaagcaaaaagacgttgtggtttagagtagcaagggttggttgcagttagtgctgcgaggtgctttatgtacttctcattcgatccttataatggtgctttaaattaggttgtatcatcctcattttcagaagacgaagttgaaacttaataacttgcctacgggcacaggctgttatagaatttggcagtcgctccccaggtctgcctactctgagcctgtgtcctttcctctctctcactctgcctgaagtcacgtccaggtagcatcatatctgctactatctcgttttcctcttcgctttggacttcagattatttttcaatggatagagagaaggtatatttctctattacttaaaattttttcattggacagatatgtgggattcttacatcacaattcatctggagtcagtgaagggcaggaatgggtatctggagcagttttcacatactaattaacatatccagtttctatgctttaccttggaattctatcattcatgataacactcattatttcaggctgatcacaagttctgatgggtagctatatatgtttttgactgatgaaacctaaagaatagttcattaatggatgccattcgtctaggaaattaaatcttcaaaaattgggtctttttgggaaaatagaataaaagaacctttggtaaaaaggtagttcttgtagttgatagtacttgggattagtgatcttgcaagttaatgatcctgagtcctgcctcccattaacctttaatgtcagctgtcacaaaaaaacaaaaccaaaaaatggctatgagcttaaaaaatcattttacttttgctttcctgtgttctggttcatcaaagcagtcttttctttgctcgttaagaaaaaagagaccctgcaaataaaatactaaaaacctcactagtggagttgacttatcagtgttccaaaatatttagtgctccagaaaattcaatcataaaaactaaattatgaaaatgaagatcttctggctgggcatggtggctcacacctgtaatctcagcactttcagaggccaaggtgggcagatcaccagaggtcaggggtttgagaccagcctagccaacatggtgaaacctcatctctactaaaaatagaaatactagccaggtgtggtagtgggcacctgtaatcccagctactcaagaggctgaggcaggagaatcacttgaacctggaggaagaggttgcagtgagccaagatcacaccactgcactgcagcctgggtgacagagcgagcctccgtctcaagaagaaaaggaaaaagaaaattaagatcttccactccttccctccttctcctactgccttcctctcttcccctcctctccctcttccttcccccacttattttctcattctcttgctctcattctctcttttgttccctcattttctctgcctttctcattctctttctttctctgtctctctcttattttctctctcacattgtttgcactgtagctgcctctcctttatgtgaacactaagcaatatcatgtttgccccaggttgccatggaaatgttgcaagtaggccttttaaggaagctgacttgctccattagtgaaatcatactcaaattttctgaggatggtaatttaggaatatttctacatagagataagggctcagaagtctgaagtctaggcacacctcccaaccccaacttctattctcctacatatacagttttcttccattgtgtcttcttggagacctgggtatgattttattgagggcatatgtggatttctttagacttctattattctctgattttttttagtccacagaacagtgacttccagtatgccctttttcagagcagaagggaagggtataaattgaagtttggggcatataaaacctggcttaaggtggaaacaaaagtgttttacagtgagggagagaaatcttgactcctgcaaacgcatgcaggtagaaaaaggtgaagattttatctggtaaaagggattcctaccctcctctttgccctccgcaccaaaataaaaaagaaagaaattgaaaagattcaccatcctccggatggtgaggagagaaatgagtcatatgttcttggcctctagggatgggatgaaggaaatacttggtactgctgcagccccaatggaaagggatttaatgcccagtatagcaatagagaagggcaactttaggaaggcccaagtttcattaagaggtttaacactctagcagaggcatcctctatgcactgcagtgaatagcagcttctccctcacacaaatatgttctgaggttctaggcactggagatagagttatgaatagatacaattccctcccttcctagagtacatagtcctactgggagaggcaggcaacagatttcaaaaattgctaagaaaatatcagatggtaataaacaagaagaaagaaataaacaggatagtgagaaaaaagctagtaatgatggaaaggatactcatgataggatggttagaactcttctttgaggagataacatttaaactgagacttatagatgagaaggaactagccacacaaagagccaggagagaaacagtattcagatagagaaaaaagcaaattcgaaagccctgaaataagaagtgtttggcctttcttaggaaccaagggaaagtatgagcagtgtgaaatattggcagaggccagattgtgcagattgggatttataagccatgtacaaggaatgtggattttattctgagtgcagttaaaagatattgtgggattttaaactggagtgcaacctatcagattgtgctttaacatgattactgtctgcagagtggacagtggattgaaagaggtcagcagtggaagcagaaatattggtggggaggctactgcctttttccaaggaagagataaggtgatcttggattagaatgataacaatgaaggtgaagggaagtggaaggattttggttataatttgaagatagagtcaacagggcttgcccatgggttagatggggggatagagaaaaagaaagaaaagactgttttcctttctggttttagtaactgggtagcttaaaatggagtgttggaagggtggtggttaggatttgcaagtgagacagcgatttggaaaaggagaagtctgcgtgagactggcagagtcctgaaattgacagatcaagagcagttaattcagccactgccctgctggtaaggagggcagtgagagaaaatgagagaaatgttgcaaataggccttttaaggaagctgacttactccattagtgaaatcatactcaaatcatactcctggaggaaagaagtaggtccctggaggagactgaaggtgagaagctgctcagcccactcttgtggtaggggaagcagttaacagatgcagaagagattctgcctggttcaggagagaatgggaaaacttggagttccaagatttggtggaggagggtgggttgaggttcttgttgcctttgttgtgatcaggtacctcaattttaatcctcaggctgatggaatccagagaaacacctgttgaatctgtaataggaaaaatcactggaaatgaaaaccacactcttctatttataaaagagggttgatttgataaagggatgagaaataagatgatttgcaaagttctgtttccgactactcatgaccacagggataggcaaaggtttattaccaaggactgtgctaaaaaagcccgtcgtgtgatatgttgtaagtttgcatcacgtaaacaaaattaggatatgtgctgctggttgcctttaaggaattataacttcaatattatactttttttaaaaaaagaaaaaagaaaagaaaggcatctttaggataatcaatacaccaactgtgacttgtctcctttaggaagatggcatagcataatagcttaaaagcatggactcttgagctgcctgggttctaatctctgctttaccacttacccgcagcatggtcttgggtcagttagttaacattctttaagcctaagcttttaaatctgtaaaataaggatgtagagcctccctcataaggttgttttgatgataaaatatgttgatatttataaagtgcttaaaacagtacccatgtcagtgtttgttaaataagataaaatgaataagcatttgaataggaggcaaatcgaagaaatgtaagactagcccaaaatacagggtcatttttttttaattatactttaagttttagggtacatgtgcacattgtgcaggttagttacatatgtatacatgtgccatgctggtgcgctgcacccactaactcgtcatctagcattaggtatatctcccagtgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcaccacactgacttccacaatggttgaactagtttacagtcccaccaacagtgaaatacagggtcattttatagagccggcaggacaaagaaagcagtcagctgacagttgaaactcaggtctggagtagccagcattggttctgaagtaggacaatggtgcttgttatgacttcattagtctcttcttggctgcaggaaaagagctgataaagaccttttgaggcccagagacaggtaaagtatccctagatctctaacaacactaaactacatacaaataacacagataactttccgttgacataggactaataggattttagttccagaaaaatcactgtttttccgaagttcattatgaatcccaatgtgtcttttagaaactttttagaaacttcctctcactaaggttctttttttttttttttttttttttttttggttggggagagggggccatcgcttctgtcagaagaatagacaaaataaaacaagttagttttctttttcttttttttatgattatactttaagttctagggtacatgtgtacaacgtgcaggtttgttacatatgtatacatgtgccatgttggtgtgctgcacctgttaacttgtcatttacattaggtatatctcctaatgctatccctccccctccccctccccccaccccatgacaggccccggtgtatgatgttcccctccctatgtacaagtgttctcattgttcaattctcacctgtgagtgagaacatgcggtgtttggttttctgtcctcgcgatagtttgcccagaatgatggtttccagcttcatccatgtccctacaaagggcaggaactcatccttttttatggctgcatagtattccatggtgtatatgtgccacattttcttaatccagtctatcattgttggacatttgtgttggttccaagtctttgctattgtgaatagtgccgcagtaaacatacgtgtgcgtgtgtctttatagcagcatgatttataatcctttgggtgtatgcccagtagtgggacggctgggtcaaatggcatttctagttctagatccttgaggaatctccacactgtcttccacaatggttgaactagtttacagtcctaccaacagtgtaagagtgttcctatttctccacatcctctccagcacctgttgtttcctgactttttaatgatcgccattctaactagtgtgagatggtatctcattgtgattttgactcgcatttctctaatggccagtgatgatgagcattttttcatgtgtctgtgggctgcataaatgtcttcttttgagaagtgtctgttcatatccttcgcccacttttagatggggttgtttgatttttttcttataaatttgtttaagttcttcatagattctggatattagccctttgtcagatgggtagattgtaaaaattttctcccattctgtaggttccctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggggttttatggttttaggtctaacatttaagtctttaatccgtcttgaattaattttagtataaggtgtaaggaaggatccagtttcagctttctacatatggctagccagttttcccagcaccatttattaaacagggaatcctttccccatttcttgttttttgtcaggtttgtcaaagatcagatggttgtagatgtgtggtattatttctgagggctctattctgttccattggtctatatctctgttttggtaccagtaccatgctgttttggttacggtggccttgtagtatagtttgaagtcaggtagcgcgatgcctccagctttgttctttttgcttaggattgtcttggcaatgtgggctccttttttggttccatatgaactttaaagtagttttttccaattctatgaagaaagtcattggtagcttgatggggatggcattgaatctataaattaccttggacagtatggccattttcacgatattgattcttcctatccatgagcatggaatgttcttccatttgtttgtatcctcttttatttcgttaagcagtggtttatagttctccttgaagaggtccttcacatcccttgtaagtcggattcctaggtattttattccctttgaagcaattgtgaatgggagttcactcatgatttggctctctgtttgtctgttataggaattctgttataacagaacagaatcctgttctgttataacaggaattcctgttataggaatgcttgtggcttttgcacattgattttgtatcctgagactttgctgaagttgcttatcagcttaaggagattttgggctgcgacgatggggttttctagatatacaatcatgtcatctgcaaacagggacaatttgacttcctcttttcctagttgaataccctttatttctttctcttgcctgattgccctggccagaacttccaacactatgttgaataggagtggtgagagaggacatccctgtcttgtgccagttttcaaagggaatgcttccagtttttgcccattcagtttgatattggctgtgggtttttcattaatagctgttattattttgagatacatcccatcagtacctagtttattgagagtttttagcatgaagggctgttgaattttgtcgaaggccttttctgcatctattgtgataatcatgtggtttttgtctttggttttattcatatgctgaattacgtttattgatttgcgtacgttgaaccagccttgcatcccagggatgaagccagcctgatcctggtggataagctttttgatgtgctgctggattcagtttgccagtattttattgaggatttttgcatcgatgttcatcagggatatttgtctaaaattctctttctttgttgtgtctctgccaggctttggtatcaggatgatgttggcctcataaaatgaattagggaagattccctctttttctattgattggaatagtttcagaaggaaaggtaccagctcctctttgtacctctggtagaattcggctgtgaatccatctggtcctggactgttttggttggtaggctattaattattgcctcaatttcagaacctgtcattggtctattcagggattcaacttcttcctggtttagtcttgggagggtgtatgtgttgaggaatttatccatttcttctagattttctagtttatttgtgtagaggtgtttatagtattctctgatggtagtttgtatatctgtgggatcggtggtgatatctcctttatcattttttattgcatctatttgattcttctctcttttcttctttattagtcttgctagcggtctatcaattttgttgatcttttcaaaaaaccagctcctggattcattgattttttgaagggttttttgtgtctctatctccttcagttctgctctgattttagttatttcttgccttctgctagcttttgaatgtgtttgctcttgcttctctagttcttttaattgtgatgttagggtgtcaattttagatctttcctgctttctcctgtggtcatttagtgctatgaatttccctctacacactgctttaaatgtgtcccagagattctggtatgttgtgtctttgttcgcattggtttcaaagaacatctttatttctgtcttcatttcgttatgtacccagcagtcattcaggagcaggttgttcagtttccatgtagttgagcagttttgagtgagtttcttaatcctgagttctagtttgattgcactgtgatcagagagacagtttgttataatttctgttcttttacatttgctgaggagtgctttacttcccactatgtggtcaattttggaataagtgcaatgtggtgctgagaagaatgtatattctgttgatatggggtggagagttctatatatgtctattaggtctgcttggtgcagagctgaattcaattcctggatatccttgttaactttctgtctcgatctgtttaatgttgacagtgggatgttaaagtctcccattattattgtctgggtgtctaagtctctttgtaggtctctaaggtcttgctttatgaatctgggtgctcctgtcttgggtgcatatatatttaggatagttggctcttcttgttgaattaaaccctttaccattatataatagccttctttgtcttttttcatctttgttggtttaaagtctgttttatcagagactaggattgcaatccctgcttttttttttccatttgcttggtatatcttcctccatccctttattttgagcctatgtgtgtttctgcacgtgagatggatctcctgaatacagcacatggatgggtcttgactctttatccaatttgcgtctgtgtcttttaattggagcatttatcccatttacatctaaggttaatattgttatgtgtgaatttgatcctgtcattatgatgttagctggttattttgcttgttagttgatgcactttcttcctagcattgatggtctttacaatttgacatgcttttgcagtggctggtactggttgttcctttccatgtttagtgcttccttcaggagctcttgtaaggcaggcctggtggtgacaaaatcagcatttgtttgtctgtaaaggattttatttctccttcactatgaagcttagtttggctgggtatgaaattctgggttgaaaattcttttcttcaagaatgttgaatattggcccccactctcttctgacttgtagagtttctgccgagagatcagcttttagtctgatgagctaccctttgtgagtaacccgacctttctgtctggctgcccttaacattttttccttcatttcaactttggtgaatctgacaattatatgtattggagttgctgttctcgagtatctttgtggtgttctctgtatttcctgaatttgaatgttggcctgccttgctaggttagggaagttctcctggataatatcctgaagagtgttttccaagttggttccattctccccgtcactttcaggtacagcaatcagtcatagatttggtcttttcacatagtcccatatttcttggagactttctttctttttactcttttttctctaaacttctcacttcatttcattaatttgatcttcaatcactgataccctttcttccatttgatcaaatcagctactgaagcttgtgcatgcatcatgtagttctcgtgccaaggtcttcagctccatcaggtcatttaaggacttctctacactgtttattctagttagccatttgtctagtcttttttcaaggtttttagcttctttgcgatgggtttgaacgtcctcctttagcttggagaagtttgttgttactgatcatctgaagccttcttctctcaactcatcaaattcactctgtgtccagctttgttccattgctggtgaggagctgagttcctttggaggagaagaggcgctctgatttttagaattttcatgttttctgctctggtttctccccgtctttgtggttttatctacctttggtctttgatgatggtgacgtacagatagggttttggtgtggatgtcctttctgtttgttggttttccttctaacagttatgaccctcatctgcaggtctgttggagtttgctggaggtccactccagaccctgtttttgccagggtatcaccagcagaggctgcagaacaggaaatattttagaatggaaaatgttgctgcctgatccttcctctggaagcttcatctcagaggggcacctggctgtatgaggtgtcagtcggcccctactgggaggtgtctcccagttaggctacccatgggtcagggtctcacttgaggaggcagtctgtctgtcctcagatctcaaactccatgttgggagaaccactactctcttcaaagctgtcagacagagacatttaagtctgcagaagtttctgctgccttttgttcagctatgccctacccccagaggtggagtctacagaggctgacaggcctccttgagctttggtgggctccaccctgttggagcttcccagcagctttgtttacctactcaagcctcagcaatggcagacgcccctcccccagcctcgctgccaccttgcagttcgatctcagactgctgtgctagcagcgagtgaggcgctgtgggcatgggaccctccgagccaggcatgggatataatctcctggtgtgctgtttgctaaggctgttggaaaagcgcagtattagagtggggagtgtcccaattttccaggtaccatctgtcacagcttccctttgctaagaaagggaattccccaaccccttgagcttcccgggtgaggcgatgccccgccctgctccatgggctgcacccactgtctgacaagccccagtgagatgaagcgggtacctcagttggaaatgcagaaatcacccctcctctgtgtcactcatgctgggagctgcagaatggagctgttcctattcggccatcttggaacctcctcagttttatttttcttacaatttgtttttctcctgaagaagtaactctaaattttttattgaacacacaatgtgtattttattcctattaaccaggatgttgcctcctccttcctgttttgttccaggtattgatactcaaaagatttataattgcattttttatatattagaggaactaccaagtggtgctttatgagaatcaaatggcaaaagtcagcatctgtagttggatcagggtagtaattataagcagcacatttatcttattccttctgtggagtagagcagaattaaggccctttttagagttatagggctgcataggtttggagagccctcatccatctgcttccctgtaggttcaactctacctaaacgtttctagaaagatgaatatcttattttttaagggcctttgagaattaaatttcgaaacctccttctaagtcatttctgtgtttaggatattcactgtcaggacattattttattcaagtaaaatcccattacaaagacacagatatttcccccgtctcttgaatgccctacagaaataatgcttcgttgcgctgactgcaatggactacattactacaataaacctataccagcaaactttttttctgtccccaattccataccagctagtttataatacagatatctggtcttatgtctgctttgcaggggaaagaagaggacaaaactggggaagaggtatgagaggtttccttttataacctttcctctttgctgctaggttgggatcactcgcaggtttaccattgacagagtgaggtgagctcgcttgttttctgttcttatccatgggttgggaatgttatttatagcaatatactaattataaaaaaattctactcaaaccaaagaaacaggaaggtctgttaaggggagatcaattagtgatgaactcttagctgtatttgagtcccttttctcttccccagtgtttgttagtcttctggtcgttttgattttcacattcttctgaatgtatcccatgagaaagtcctagtagatgctgttggactaagaagaaacttaatagttaagctatgtctctttagtaattaaagggggtgctgcaaataatttagtaaaaaaaaagagggggagtgctaactcatgttggttggtcaggtgtgatagctcacagttaacatttgtttagccaacttaattccaaggttaagcattagttgaaatctctcttttttgaataatattgattgcatgatcctgaatgttcagcattaagtcagcttaatgtatttcttttaggaagtaaaagttatcatctggtatatagtaaggacctaatgtagttcatatctctttctttataattaaaaatatattctcacttcgcagcagatactatgttagctgcttagcagcaacatgttcataaggaaggaaaatcttatacatttaattctgcccagaggggtgctataaagtattatgaacagaaagctgaactttcataacgaagccattgtggatattgtgtcaagacgtcattttaataatccaaattttaatcatcctgactttacctgtcacatcgtattttattttctattagccacacatctctgaaatgttctctaagaggcagtggtaatagaatctatacctgtcctaatatatttgcattgtcaggcattgatgagagaataggtttaatatactttgtacaaagctccccacatgggctcagtctctgtgtggaatatattttctatgtgactaacaatatgaacttaacagcatcttctcattatggagtcatcatgctcaagcgatttgtctccatttttattgcgtatcactcagaagtagggtttatattgaaatgtatcctggatgaaggccctgctaaaatatttcatgtttatattcctccagttctactactacatgtgctcctctttggaactgtcctttaagactactttcaaacatcgggtataggcttcaaaaggtgttcatcttcatctttatacacaaagagcaaacgttaagcattgtaattcatccagataattgatcataagccaaaagttccagttgggtagagggtaagactgttgcccctgggatggagaaatgggtatcttggatgaaatgctctaatagtgtggactagatgatctggtagaaagaagattcagtgtcaaggtgttagctgtttatgtccttatagaatttatagattatcttagtgtgcttgcttcttcctcttcaattgccctgatttgggctgccctgggaacatttatattcagcaaacattttttgagcaatgcttaagtacaaacttaaagaaacaagtttgaaggccaggcgtggtggctcacgcctgtaatcccagcactttgggaggctgaggtgggcagatcacctgaggtcaggagttcaagaccagtctggccaacattgatgaaaccccgtctgtactaaaaatacaaaaaattagctgggtgtggtggcatgcgcctgtagttccagctactcaggaggctgagacaggagaatcgcttgagcccgggaggtgtaggttgcggtgagccgagatcgcaccagtgcactccagcttgagcaacaagagtgaaactctgtctcagaaaataaaaataaaaaagacaacaacaacaaaaaacccagatggagatcacatcttttttttccatttggatacttatgaaaccgattgtcaagttggaggttttgggttatatctgattcctggttccacacaagaatttatgtgctgtctgatctgtttatcctctaatgcattttgatctttaaagttacttcaagtcattaaacatttgcattaattgaaaaataggatttattattcagtaattctgtatattttaagatttctttcctcttctttctagggaaattaatgactttcttttttaaaccagcatcattccccaatacagcattgtaactaatgatagctgggatatactcaattccaaatggtccagtgtcatttttctgtatagtaggagtgaataagatcatctgtagattagccagaaggaaaatggctttgtgttttacctttgtagcagcctcttgaaggatatctaatttgatacagttatctgtaagaaatagaataaagcaagataaagcacgtatgtttagatgtgtggctgacagctctcctgaaagcagaaagtgctaattttttactttaaaaaaaaatctggaagaaggcctcaagtaattcaggggaagacaaatgatgctgaaatgaagtcacgtgactcagtggataattccagtgaaacccaggaagaaccgcattagtgatagtctgtaagtatacaccgtgttttacaataggttgattgcactaaacaaaggagaaaatcctttctctgaggagcttacagtctaaagatacaagctggtgcggtacaatatggaatgagaacaataagtgagccccatggtaggtggtcttcatagctgaaatgcttcgaaacaagtgccttcttggaaaggtagaggttggagagggagtggcccaggtgtgcaaagaagttgaaggctgttcttttgggactggggaataaggataaggaaggagagggctggatagtgtgtctgaaaagaggctcgacataaaaatgggtaaagagatcagactgacattggcatggtacagcgtggtgatttagagaacaaggggaaatgccagcagaagaggactgagagagaggggcaaacaacataccttaagactgtattacagcaaataccacgtctttaaagattctccagatctctccctagatctggagaatgctgcttgtaacagactcttgccagtgtgaatggattctgtaccagaggaaagaacagtctagtatggttggaacaatccagtaagattctgtatgtgaaaagggctttgtacaaacctctcatggggttttataaaagctcttttgtacaaaaaaaaaaaaaaaaaaaaaagcaaagcagtacaaatgtacatcatcatcattttgcctagctttgactttattaaatttttggttggtaaagtattttaagaaaaggttagcagtagaacttcccatttcagagatgttatcagaaacagatttgatattataaatgcttcacttgtttccatgttagcttgttacaacttctcatagtaaatgttcccacaaagggctctctattttccttacagttgaactaatacttcacataagtgaagatcctcattctcatcctcattcctgccccctctcttgttatccagcctctttttcacttgtgttcatatgctcatatgttttctttggtctcacaaaactaattttatagtctgccttattccagcaaggatatcagttggtttaccaagaaatacatacaataacaggattaacaaattgacagggaaatgggtatgaagggaaaataattataagaaacaaaatgaggccagggtaaggttagtacaccgagtatacagcactggagacttatgattgtgccctaaatttgactcagcttcttagcagacggatcaaggaaggaaatgttagttataacagttgcaggtgtctataaggtaaaaatgaactcgtttctcagaagcagcacagcttttcttgagacttgtaagaaattcctcccatggggttttataaatgccaatttgttgggtatgaattttatcctgggggcactgggaagccagtgaagtttttgatttaggggatgacatgcacaaagccatatttaaagcaggtataggaaagctcaaatgagttgcgggggaactagatgcaggaacaagttagagacgaggctctaagagtctgggcaacaaggatatatagagggaatggcagatgaagaaaagctataagagaggttaggaagatgtacaaggtcattgcttagatatcaatggaaaaggaagaatcaaggatgcctctagggttcaggtatagctaaagtaatggtatcataatcccttgcaagtaaaaggaggaaagatgtgttaaagtgtaaagcccagaagatgatgaaaaagctgagataaccactatgggttcttatagtcacattttagaacaagcagaacaaagaaaatggagagttatcatttatttagcacattatagtttatgaagtacttttacatacagtatcttattttgtcctcatgacattcctgtgaaggaagtagtactatccacattttacagataaaaaatcttggactaaatgattaactgacgttttagtaagtgccttgtttttcccccactgtattacactgcctcaagaagaccacctgcttgcagctattgacataatattatcagatgaaaatatcaggacaaggttagagttttgccatcattataaacatgagtattttgctttgctttatacaattgttctactggggacatttgataggaataggactgtttgcccctacactaaatgtccccagactactatgcttttaaaatttaatatctgctttttatacttctttaatctcttccactgctgtcagctgttactacttgatgcgtctggcagttcccctcctcctaatcatttgtacccctggaaaccaaacaaatatgcttgttacttttagacacaatcttaagagtgactatgcgttgaattagaacatagggagtcctcttatgagaactctaacccttatttatgtttttacgggtaaagaacataagtcttactgtacattcattcttagaatatataattttggctctcttctagtgtcttggccaattttgagtagttgaaagtgctggataagttacctagaaaagtgaggtatcagtatatatatttaatatgtaaccttggccaatactttttaaaaataggtgttttggtggtgactggaaagtaatcatgctttacaaagggaaggttgtgaatttttcgtgaatagtagtctagatgccaaaggtttgaagtgactgcccaacctcctttattccagaatgactggtgaccacttctctcagtccccattcccctctactggaaaagttgcagacattttctttgttctccagtaagtctttcttcccaaaacagtcacagaagcttccaaccagccctttcttggttcacttgtctttctctttttccctctgcgaggaaggcttttcataaagatttattgactatccacgcggcattgttcctataggaagcactgaactcctcagtgtgaaatctgtgtctccagctggctaaataaagtactttgtgacacttggtacagcatgtgcataattcagatgtgtggactgtggcccaagcatcatgagcactcagcccatgtccaaatagaagcagtgttttttttacaaatttacttttcaaattaatttttaagatgaacaattagtggctaatcaatacatttattaagccacctgaactgagtagaaatgagagagaagaggaaaggtgatttcccttcacactcgattgaagtatgaaattaataaaagtagatgtcattggaactcagcaagatcagtaattaaaactcttggtctttcagatgttcctaggaaagattgtatccttcattatgatggaaatggaaaatgcttatttctctgcacaggtagtttgggacaaaggaactacttttactgttagttagaaatatcctcatgtcaccttgtgcccagaaaaataggaatgattttggattagttgtggtctgttaaaaatacagtggtgatattaccattttatggctttgaattgagctttgggaaaaagtttctactttgatgcttttaggagctcatgattggatataagattttacaaagataattgggagaaaacaacttcctatgtccttttatgaattcatttaaggtgtaaaagtattttctagaaataggcagggtatctaggccttgataggagtgagggacatttcttcagctttagtagtcatcctgttttgcatgtgaccatgtcagtatatccattttagactggcctttcagaagaagagaaatttgcttttccttctttttgcttttgtatctaagtgtctattacaggaacatacatttggtgggtattcaaatgcctctgatgagatgtttattggtaaatgaaaaatgttttctgaagggagcaaatggtatgctctctaaagataatcagatttatcagttcaaaaatatggcaatgcaactgaagtatctagattgaatggtaaactatgaattatgcctacacaatgctgcaactgccgccttatgtgacctcaacttttgcagtataatgaaggtatattattaaacatttaaatagcctcacttactgaataaacaatcagtggcttgataaattatgtttggacctagcactagagatacttcactcattatagtgcttgtgagcactaaggccaacccctgatatttgagggacattatgcaaatttccccagagcagcatggtttggagttctctgtctgatacatcagttagcgttagtgccctgtggctaaaaaggatatgatgatgggtgagtatccaagtgtaaggttaaaataaaccaatgagttttgaggctttagactttcatttcatttcatccatcagctacattgagctttcctttagaaaaccagactagcgttgacctgctagagtccctggggagactatgctataataaattttgattaggtattagtagatataagagagagaagagatgagctagccaggaagggtgaggtgggcagaagggacattactgagctgaggaggggataattagattagaacaaaggaaagtgtatatgcctcctcactcttcctctcaactactgttttggtctagcaatgaaccttgctcattgatctcttatccttcctgtcttagttttcttccaccactaccactaccactcccattcattttttattcttttttttttttttttttttttttttgagacagagtctcactctgttgcccaggctaaagtatagtggtccaatctcagctcactgcaacctccgcctcctgggttcaggcgattctcgtgcctcaaccacctgagtagctgggattataggtgcctgccaccatgcctggctagtttttgtatttttagtagagacagggtttcaccacattggccaggctggtcttgaactcctgatctcaagtgatccacccgcctctccctcccaaagtgctgggattacaggtgtgagccaccgcaccctgcccgtttcttattcttgatgccttctgtccttctgtatattccctaataagtattacataataaaagaaagacaacaaggaaaactgttgtttttctttgtttttgttgtatttttgaaaaatatttcctactttttcccctttacctttcttcattgatgctgcccaaataaaacctttatcagataatctcctttaccatatttgtacaaaaggattctattataaactactgcagctgagctcattttgtttatttaagtaataatattctctggatgacatctcaatcactctgacaccttgtcatctagggtggcatcccagggtatttataatcttctcaatggttagcatgcaattctcaaaccaaattaatttgaagtcactttaacttaaaatgatttgaaaagatccccaaatcaaattgtcataggcatggcaccgcctaacaatcagagattagtgctttggaacaatgattcttaaactgtttagcttctgaaggaaatatttagtcaacactccaccctaagaagagggacaatcatttatcactgaacagccagaactttctgatctcaagcactctctcaaaaaaagttcttaaaggctatgagagaatgtagcaacagtggtggacctaagaagagaattggcttacctattcattcattcattttcatgcgttcattcaacaaatatatactgagggcctactatatgccagcattattttatataggttctatctaccttgttatacaaaagataatattacctggtttgaaaatgctcattctctagtggtgagtaacctacggttaaattagagtaacccttagttccatttctctttggtaaccaatgattcagtactatgtagtttggatcactttgcagtatagtggttttgtcttcctattctgtgatgtttttctagcctgcagcctcttacccatcattcataaccatcactggtgttcattgaattgtacttgtagttgtttgcaatgtgttggttttaattttctttctttttgaactttttattttaaaatattttaaacataactttttattttcagaaatacaggaagtttcaaaaaatagtacagagaagtctcttgtacccttcattcagttttccccaatgattatatattatataattagagtacaatattaaaaccaggaaactgacattggtacaatgtgtgtataaattctatgccatcttatcacttctgaggatttgtatagccaataaaaacaattccatcaccacgaagatctctttcttgctatctacccctttagagtcaaacctgctccctaccattcttcactatctgtagcccctggcaaccactaatttgctttccatgtctaaaactttgtcatttctagcatattaaagaaaaagaatcgtacagcatgtgaccttttgggattggcttgtttttcactgagcacgatacccttgagatttatctaagtttttgtctgtatcaatagtttgttcgttgttattgctgagtagtattccatgttatggatgtaccacggtttgctcaattgtttgcccactttattgttctatttccttgttcactgattcttttctcctgttctccctgttctgctgttgagcccacacattgagttttcaatttggcaagtatattttttcagttctaaaatttccatttgatttttttgtaggggggaagtatctggcatttttttttaacttctattttaggttcagggttacatatgcaggtttgttatataggtaaactcatgtcatgggagtttgagattatttcatcacccagatactaagcctagtacccaatcgttattttttctgaccctctctctcctcccacccttcactctcaagtaggtcccagtgtcttataggtccttaggtcccctctttgagtccatgtgttttcatcatttagctcccacttataagtgagaacgtgtagtatttggttttctgctcctgcgttagtttgctaaggataatggcttccagctctattcacgttcctgcaggaggcatggtctcattctctttcatggctgcatagtattccatggtgtatatgtaccacactttcttaatccagtctgtcattggtgggcatttaggttgattccatgtctttgccattgtgaatagtgctgcaatgaacatttgcatgcatctgtctttgtggtagaatgatttatattcctttgggtatatacccagtaatgggactactggatcgaatggtagttctgtttttagctctttgaggaatcaccacactgcattccacagtggttgaactaatatacactcccgccaacagtgtataagcattcccttttctctacagccttgccagcatctgttattttttgactttgagttggcctttgctgaaggtgctatggatgggagtggagccacagtcttatccgtggtgtttaggtggagtaggaaggtgattagaattattctgtcttgccaggctgccattttcctagtcctttggctagaaagagccacctttccttgtgacttgatgttaaacacctagaaatccttaaaagtagtaacataattactagtaacattgtgattgtgttaattatgccacattttacttactttttagtacttttattgaagtattgacatacaattaagtacatttaaagtttacaatttgatgcacacacccatcaccacaatctaaataataaatatacctatcatgcccaaaagtttacttgtgtccctttgtattccctccattccttccctactcacctcctcctatcctaggcaactgttgatttgctttttttttcaatacagattagtttgcatattctagaatttttataaatggattcatagagtatgaactttttctctggtttcttttactcagtataattatttttatactcatccatgctgtcatgtatataaatagttcattcctttcttattgtttagtagtagcagtatattatagatatgtgacaattcatttttcctttcaactgttgataaacatgtgacttgtttccactttttggctattacagataaatgctatgaacatttgtatacaagtgtttttgtgtacacatgcttttattcttagataaaaagacagtggaattgctgggatatatggcaggtgtatgtttacctggtaagaaattgccaaactttcaaattttgcactagcactagcagtgtatgagcattccagttgtttcacatcctgacaagacttggtgtactaagtctttttaattgtagccattctagtagatgtacagtattatttcatgctaagaagttttaatttgcattttcctaatggcagattatattgaacatcttttcatgtgcttatttggcatctgaatatattatttgatgaagcattcattcaagtattttgctgaattttaagttctttctcatcttattattgagttgtaagagttccttatatattctaggtgcaagtcctttgtcacatatacgttctgttaatagttttccccatctgtggcttgactttacattttcacagtgatgtcttctgaagagtgaacatctttaatgttcatgaaatccaatgtaatgatttttccccttttgtaatttctggagttttgtaataattaagaaatctttgacaaacctaagtacattgagattttcttctgttttcatcaaaaagttttataattttagctcgtacatttaggtccatgatccatattgacttaatgttttatacaatgtgtagtaagtgccaaggtgtctttatttatttttttgcatatggatatccacttgtttcagcatggtttgttgaatagacagttcttttcccaatgtattgcattgacatctttattgaaaatcagttgatgatataagagcagatctatttctcggttctattatgtatcattaataaatttgcctgttttacacaataatatactgtcttgattattatagttttatattaagtcccaaaaaagtaacatatgtcctccataattgttcttttttgaagttatttagactcatctaggtgctttacattttcttacaaattttagaacccaattgtcaatttctacaaacatttctccttatttgggtttaatgtgttgttcttctactagttatttaatgtaggaagatggagtcattgatttgagaactttcttgttctttcctaacgtaggcatttagtgctataaattcccccaaaatattgattatgatatacggtttattcatcatcattcagttcacaatctttttctaatttctgttttgatttcctctttgacctatggattagttagaagtgcaatatttaatttccaaatacttaatgattttctagatgtctttctgttcttgacatctaatttattttcattgtggtaatggagcattctttgtgccacttgcattttttaaaatttgttgagacttgtttcatggcccagagcgtgatctagcttggtaaatgttccatgggcagttgtgtactcgtcaatgctgagttgtgtgttttataaatatcaagtagtttacttggttgatagtgtttgcaaagtcttctgtctcctaactgattttctgtctacttattttatcaatattaagggatgagtaatgaaatctctgaatataattgtgtatttgtctatttctccttgcacttctatcagtgatccagctttcttttgattagtatcagtgtggtatatcatttttcattctttaacttttaacccatttgtgcctttatatttaaaatgtgtttcctgttaagcagtatgttgttggatcttgcttttttaattccgtctgacagtctctgcctcttaattgaggtgtttaaagcacttcgatttaatgtgacaattgatgtggttaggtttaagtctatcatcttgtcatttgctttttatttatcccagatattctttgttccctttttcttcttttcctgacttctttttgattaagtatcattataattatattgcaaagcctttgttggatgattagctttatctcttagtatgttaggggttgctttagggtttatagcacacacaacaagaaaaaaaattatgtaattattatttctggtgttcttcattcctttctatatatccatattttcatctgatgtcattttattttttcctgaaggatgtgctgtaacatttcttatactatgggtagtaggcaatgaattcttccttgtatgggcaggggtggtgtgtgtggtgtaaaaaggcaacatgatgggattgaaagtgtgggattgaactcatagcaatcactaatctgttctatctttataattttctcacttctagattattttacaaaaggaatcatagcgtatgtatgtccttttgagattcgccgttttcactcagcacaattctctgcacattcacccaagctgttgtgtatatcaagaatttattccttttatttgttcacagtttgtttaaccattcacatgttaaaggacattgatctatttccagtttttggctataatgatttgagcttatgtgaacatttgtatataggtttttgcataaatataagtttccatttcccgggattattgctcaagagtgcaattgatggattgtatggtagttgtgtgtttagttttataagaaactgccaagttgttatccagagaaactgtacaattgtacattcccactaataatgtatgagtgattccctttttccacagccctgccagcatttggtgttgtcactcatttttattttaatcatacagataggtgtgcagtgatatctcattgtggtttgaagctgcattttctaatggctaatgtggcagaacatcttttcatgtgcttattttgccatctgtacaccctcaggtgaaatagctcttcaaatctcccattttctaatgggattttttttaactgttgagttttgagagctctttatgtattcaacatactagtcctcttggatgtgggtcttgcaagtatttttctcccagtgtgtagcttgtcttttcatccccttaagagggtcttatgaagagcaaaagatttaatttggataaagtccaacttaatcacttttttttgatagattaggcttttggtgccaagtctgaaaactctttgcctagtcttagattctatttgctcatattttttttctaaaagtttagttgttttaaattttacacttaagtccataattcatgttgacttaattttgtgtatgggtgaaagttagttcaacagcagttttttcctttctgactatagatgttcaactgctctagcatcatttgttgaaaaaactatacttacgccattgaactacttttgctcctttattgaaaatcagttatgtcatgcaaagaaagtatttatttatttatttatttatttatttattgagacagagtctcgctctgtggccaggctggagtgcagcagcacgatctcagctcactgcaacctccgcctcccaggttcaagcgattctcctgcctcagcccccccaagtcgctgggactacaggtgtgcaccaccacacccagctaatttttttgtatttttagtagagacaggttttcaccatgttggccagtatggtctcgatctcttgaccccgtgacctgcccacctcggcctcccaaagtgctgggattacacgcgtgagccaccacacctggccaagaaaggaagtatttttatacgtagtactccttggatgaaccttgacaacataattaaacaaactagatgcaaaaggctacatattatgtgattcagtttatatgtccagaataggaaagttcataaagacaaaatttaaattagtagttgcagtgcctggtgtgagggggaaataaggaatgactactactggacatgaggcttctttttggggtgatcaaaatattccaaaattagatattggtgaaacaactacgtgaatatgcaaaataccattaagttgtataactaagagaatgaattttattgtatgtgaatttagctcaataaagccgttatgaaaaatagattgggcatatttttatgtgttcatttctgggttatgtattctgttccattgatatatgcatgaatcactctaccagtgatggtaaagatggaatcatatgatacacagacctttatgattggctattagctgtgatgttagctgtaggaactttgtagatgcactttatcagattgaaggatttccgtgttgctacttactgagagatttttcatgaattagtgttggactttatcaaatgctttttaattttttaacatttttttgatggagtcttgatctgttgcccaggctggagtacagtggtgcaatcatggctcactgctgcttacctctcgagctcaagcgatcctcctgcctcagcctcctgagtagctgggactataggcacacaccaccatgcctggctaattttttattttttaatattttctagagacaagttttccctatattgcccaggctgatctcaaactcctgggctgaagcaatcctctcaccttggcctcccaaagtgctgggattacagacgtgagctactgtacccagcctatcaagtacattttatgtgtcagttaatattatcatgatgttcttatttatcctgttgatatagtggattacattaaatgattttctaatgttgaaccagccttgcatacctggaataagacccatttataatgaatcattttatacaatgttagcttcaatttgttaaatttttattaaggtaaaatctacataatgtaaaattcaacattttattttatttttaataatttcaattttcattttagattcaggggtacatgtgcaggtttgttttacaggtatattgcatgtcgctgaggactggggtatgattgatcctatcctcattagtgagcaaagtatccaatagttattcaactcctgtgcccctccctccctccatttggtagtcaccagtgtctattattgctgtctttatgtccatgtgtacccaatgtttagctcccacttatgagtgagaaaatgtggtatttggtgttctgttcctccattaatttgcttaggataatggtctccagctgcatccatgctgctgcagagggcatgatttcattcttttttatggctgtgtattattccatagtgtatattgactacgttgtctttatccggtcccatagataggcatctaggttgattaaatttgccactttagactgtaccattcagtgattcctagtatattcacagtgctctgcaaccattgctactaattccagaatattttcatcacccccaaaaaaccctctatccattaagcagtcattccacacttcttccgttacacattaagccgtcatttcacacctattccatccctagcccctgataactactaatctacttcctatttcaataaatttgtcaatgatagacatttcatattaatggaatcatgatacacacctttacgattagcttctttcagttagcatgttttcaaggtttgtctgtgttatagcttgtatcagaaagtcattgctttttaaggctgaataatattccattgcatgaaaatactacattttgtttatacattcatctattattgatagacagttgggttgtttccaccctttggcttttgtttataatactgctatgagcattggtgtacaagtgtctatttgtgtcgctgctttcaattcttttggcgatatacctagaagtggaatttctggatcatatgggaattctgtgtttaactttttgaggaaccactattctgttttccacagcagctccaccattttacatcccacctgcaatgcacaagggttccaatttctccatatccttgccaacacttgttattttctgtttttgttgttgtttttttttaataataactatcctaatgggtatgaagtggtatcttattgtggtttttatttgcattcacctaatgattagagatgttgcacatcttttcatgtgtttattagccatttatgtatcttttttggagaaataaccattaaagtttgtgtgtttgtgtgttgaattataagaattctgtatatattctggaattaatctcctgttagatatgatttgcaaatattttatcccatttctatgggttgtcttttcactctcctgatagtgtcctttggtgaacaaaagtttttagttttgtgggtgctggatatttttttattccataaataatctttagttctgttctgggatgcagtcaagttactaggaaacagtttaattccttcaggtattgcttttaaaattagttagatgagtacagagcagagcttagcctggtgctaattattccctactcccaaggcaacaccctgttaggcactctactcaatgcctagtgaattatgagtttttccattctggctgagacaaaagctattattactggattttgtgtgatcactagataatgttctctctaatctttttggattttttccactgtggccttgggtagttccctcacatgcatccactgattagtgctctgctgaatactcaagtgggaacatttacaggtctccaggattttctttctgcactgctttctcctctccagtactccgtcctgtgaactttagataatcttggtcttcttagcctcttagctctgtctcaactcagaaagtctgctaatctctacttgggttcttcagtctacactgcagcctagaaatccgctcacagcaataagctaaggcagccactggactcattttacttgtttccagactctggagagttattatcttttgttacctgatgttcaggttcttgaaaaccttttgttgtatattttgttttgttattttaaaaaaagcaaaacatagttttgttttgggcgttttaggctgttacttcttcttgatcagaagtgaacctgtcatattgttttaaattgtaactgtatactagtagctcagagaaatttctgattctagagacttccctgaacttgcacaggcttaaattcttagccatatgatatttgaaagattaaatatacaaatgtaatagggagatcaacgtaattatcttggttgttctctttgttcattttccaaccctacctattcaactgagtggatatctttattcctctgtaaggcacccttcaaattattattatatttgtgttgaacagaggcattaaagaatgtcttgtagaatggcatgattgattctgctgtccccaacctcccacatttaggataaactccatacatcctagttctcccaagtaaaatattatgggtcaattattgatgaacctttaaaaaatcattatatgtgtattttgaactatattttgagattcttttaagtttattgcccaccatgaaaagtattccttctttttttatttgtctttcctgaactgaaatccctgaaatttcagacagaactcctattcttccagtatttttgacagacatgtttgggctcactgccccaatgttgttcatgttcttgtatgagtttgataatatcccatctcagtcatcactttttgtaactaaagagacctcactcatccttttaatctgttttcatacaaccaccttcccttctgtacctatgccaatccttttgaatttctctatttctctatttccattctgtcttaaggtatagctcccagagctacatataatattccatattgtaactcaaatatttatataatggtgtgactgaggagaataatatccttcctttgcctttattgaagaatcccagtatttgtaaaaacttttttgatgtcttctggaaatgttcccatattccttttaagcttatacagtgactccagaacacatcacattgtaagttatttgtactgttgttcaccaaattcaccctataatctctgtaaatactcacctaattggtatgatttattttataagtccaatttttatcatttgttgtaaagttataaaatttaaatgagattaatttaatgaacgccaaaatttgaaataaaaagttatagatgatagttacaacctatatctgtctcaacatctattatatttctgtattttggttttgatgcatagtatggagaaaatcttcattcacacagataaataattctaaatggcagcaatttttaatagctcatcttgtaaccatagatcattacttaattaactgatcctaaaacttcaaagaatagtaggaaacttttattttgaaattgagtcattgacaatatctgacaagtgcttatattctttaacaaaatataagagaaacatccaaagctcacaagtgcataaattgtaatataatgtattaatttcttataatgtattaatggtagtttcttttgctgtgcagaagctctttactataatgtattaatgtcacttgttattctataactgattcttacatgacaaaagaatagttgaacagatgtgcaggggctcaatttgatgccaggcaagcattaggcacatatgccatagaattatactttttacaaatttttgtatgaacagtgatgtagtttggctgtgtccccacccaaatctcaccttgaattgtaataatcccatgtgtcaaaggcagggccaggtggagataattgaatcacgagggtggttttccccatgctgttctcgtagtagtgaataagtctcaagagatctgatggttttataaatggaagttcccctgaacaagctgtcttgcctgccacgatgtaagacatgcctttgctcctcctctgcctttcaccatgattgtgaggcctccccagccatatggaactgtagtccattaaacctcttttttttaaataaattacccagtctcgggtatgtctttattaacagcatgagaacagagtaatacaaacagaaatgcatagccctgaagaagaggggagctgtggccttcctaatcatctgcctatctaggagaattttaatatatgcacagaaatggcaggagaagatttattctgagctttaagcaaatactagttgaccctctgaaacaagttagttagtaggtggttggtcttcaacaatatatatttagtatctaacatagtcaggtgtgtgtgtattgatagttcttaactttcactacagttttttaaagtgttttaaaaatgattttcaaattaagtatttgcagaattcctgaagtacctctgtatcctagagtcctggagaatacagttttaaaactatttaagatctaaatatttattatgattctctagctagtttattttccttagttatattgacctcctcaaaaaaaaataaatacttttagtcagggattattttcctttacaaaacctatgagtcttttctccagtagcttatgacaattgtttgtttctgttgattctgggttttgttgttgttgttgttgttgttgttgttgttgtttggacaggttttagaaactttcccaatatggaggttaaacatgctggtttgtggttctatagagatctctagtgaatgttgggggtgggtaggtgagtattttgttggcagttcctcagccctttggtagaatggccataaatcatggcaagttgcacctttgtaaagggtaattttgatttatcacctgtgtctctttaaaattcttgagtgaccaggaccccaatttatacaactatacgtagtttgtcatttgggggttagaagttaccaccgtggatttagtacatctaaccgacatgtttcataagccagtttgggaataaaagactatctaagatcctctaggtaagtagtgactcacataatttacttgtttaatctctctgatagtgctttttcatctgactgtatccttttcactgtgatcttcaagtagctctgtcactttcttatatgtcctgtggtatgaccagagccatgaactgggctagactacattattttacttgtgatgccatatgagttggggaaagagaagttttgtgaaattggcccccaaattattaaagttctaaatttaagtataaattacaaaatgataaattacaaatttaggtataaaacaacgtagttttataacattgaagataaatttgcatttcagaaaaggttttgctaaaaatgcatgtggatgttgaatatgtagtatatgaaaacaaacttataccttttcttgtttagagaatgaattctacatgcacctctagtagacagggattcttgtagatagattactgtttgtgtgatttatgactcctatcataagacgttgctggttttttgtaatgaagtctaaattctcattcatgtcaaatctatataatgatcatatttagttgagtttctaaagtttatcttttaattcaaaccttctgtataatctttaatgtgcacacttttcccagttgtattatcatttaattatagcagtgtaatataaaagtcaaagttaatatacttagattttagaaatgctgacaaatagagacccctacaaatagttgagacttcattaaacatttggattcaagctggcgagccaaagcaagaatcattataccaacagtaaatgaaaggaagtatggttttgctattggttcttgattgagaaaaaataactggaggcaaaagatgagccagcctcctgaacagtaataaatagtgatctaaaactcataccactaaaggtttaagagtctgaatgccagaacgtacttgttaaatgtctcctccataagctatttggacagttctgccttttgggtgccccttcattttcctttcttgaagcgtttgctaaatgaaccgtctaaaacttcttgtggtaaaccatgatgatatcctttgtttttgacaattgaagggttcattggatttttatgctggctgttaagtacagtaatcatggtttatacatagcataagaggtctggctctctatctcctttatgtttgagatgcagttagggtaacctcctatttgagcttgaatcttgctgtcccaagttttcttagtgatgaaattgagcaaaccagtaactgacccatgaacctttagaatgatggagtaaaaacacttcctgcaattttctggcacaaccactaccttcagctgttagcaaacgttttctttaaaggaccagagaataaatagtttgggctttatgacagaattcataagatttctgtcacaactactcaactctactgttatagtgtgtaagtagccatacacagtacataaatgagtatggctgtgttctagtaaaattgtatttacaaaaataagtgttgaggaggattcagagaaattggaaccacatatattaccagttggaatgtaaaatggtacagccagtgtagaaacagtttggcagttcctcaaaaagttaaatataggattaccatatgacccagcaattccattctaaggtatatacccaaaagaattgctaacagatatttgaacaagtacttgtacacaaatgttcatagcagtattattctcaatagccaaaagctgaaaacaactcagatgtccatcaacagatgaatggatgatcaaattgtgatacacccatacaaaagaatattattcagtgataaaaaggaatggactgctgatacatgctagtacatgaataaacctcttaaacatcccaagtgaaaagagccagacacaaaatgtcacattttgtatggttcaatttatctgaaatatccagaataggtaaatccatagagatagaaagcagatcagtggtttctaaggactggaggtagatagaaatagggaatgactgcttcgtgggtatggagtcacctttaggggtgatgaaaatgttttggaactagatagacatggtggttgcataagattttgaatattaaatgctactgatttgtataattcatgcatttaatagtactaaacgctactgaattgtataattttaaatgattaatttcatcttatgtaaatttcacctcaaagaaaaccaaaaacaaacaaacaaaacgaacaaaaacagtcagctaccctgattggccatagcttgctgacctctgctctacctaattcaggaatactgtacatcttctatctccgaattatttttgtctctaatgtcattgtggttactggagaatatgttgtaaaatggtagaaaaggcttatatggccatgatacaacttgactaccaagagctgataaagcatgaaacaccaacattttctctgagggctttgtcagtcactttagtagtcatagtttaaagacagaaacaaaacttgtggctacttatatcataaaaatgtttattaagctgttgtatatgtatatgtatacagatatggttgtgtataaatgcattggctctaaaagaattctgtgtctaacctgtatcccttataacattttataaagaaagatacaaatattaataaaacatatacagatgaaatgttgtatatgtatataaatgctgtatatgtataatataaataatacctccaagagtacttacaccattatcctacagagcaaatgctctcaggccaaatccagcccactgcctgtctttgtagataagtgttttttaatggcagctttattgagatataattcacatatcatacagtttacctatttaaattgtacaattcaataatctttaacatattaacagagttgtgtaaccattaccacaatccattttaggacattttcatcaccataacaagaaaccctatacctattagcagccattccctgttttctcctgaggacctggtgatttggtttggctctgtgtccccacccaaatctcatgtcaaattgtaattcccaatattgggggaggtacctggtgagaagtgattggatcatggggacagatttttgccttgctattctcgtgatagtgagtgagttctcatgagatctggttgtataaaagtgtgtggcaattcccccttcactctctctttcctgtcaccatatgaagacatgcttgcttctctttcatccttccaccaagactgtaagtttcctgaggcctccctagccatgtctcccatacagcctgcagaactgtgagtcaattaaacctcttttcttgataaattacccagtctcacctagttatttatagcaatgtgagaacagactaatacacctggcaaccactattctactttccatctctatagatttgtctatgatgtacattttatataaatagaatcacacaatatgcagtcctttgtgactgatgtctttcacttagcatggtgtttacaaagttcatccatgttgtagtatgtatctacttaatttttttctatgattgaataatagtccattgtatgaaaatacaacattttatttatctactcatcaggtgatggccatttgggttgttttcatctattggctattattaatcttctgtgaacactcatgtataagttttcgtgtggatgtatgtattcatttctcttgtaacaaattctacctaggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaagatctttgaagccaaccaaggactgggagacggaataacttgacaaagtatctaaaatataacttgactgagctctgaaactattactagagaaaaataacctgtgtatacaccctcaaaatgaaaagaggtttgggtaactaacatgtggtgttttctccttccctcacttgtactgcaggattactacttgtatagaatacattgaagccacgtcaacaaactattttctatggatcattcaccaggtcacagaaatagtcatatttttcagaatgtgagtcttgttttgataagcctgaagtgtaagtatatctgtaggtcaataaagaattatagaaaaggaattaacatcagtatataacttccattaaaattaaacatagtgggccaagggtagatatgctattgtcattggagttaaaagtttaatcaaagcagtgaaatagttctcgctggattaaatagagatggtttcctaaagaagatggaaatctttaagcagtttaaatgacagaagagattttttttttgcttcttttttttattttatttcttattattatactttaagttttagggtacatgtgcacaatgtgcaggttagttacatatgtatacatgtgccatgctggtgcgctgcacccactaactcgtcatccagcattaggtgtatctcctaatgctatccctcccccctcccccaaccccacaacagtccccagagtatgatgttccccttcctgtgtccatgtgttctcattgttcaattcccacctatgagtgagaatatgcagtctttggttttctgttcttgtgatagtttactgagaatgatgatttccaatttcatccatgtccctacaaaggacatgaactcatcattttttatggttgcatagtattccatggtgtatatgtgccacattttcttaatccagtctatcattgttggacatttcggttggttccaagtctttgtttgctattgtgaataatgctgcaataaacatacgtgtgcatgtgtctttatagcagcatgatttatagtcctttgggtatatacccagtaatgggatgactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatggtgagcatttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttgtcttttgttgccattgcttttggagttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttttgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattaccttgggcagcatggccattttcacgatattgattcttcctacccatgagcatggaatgttcttccatttctttgcatcctcttttatttccttgagcagtggtttgtagttctccttgaagaggtccttcacatcccttgtaagttggattcctaggtattttattctcttggaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtttgatattggctgtgggtttgtcatagatagctcttattattttgagatatgtcccaccaatacctaatttattgagagtttttagcatgaagggttgttgaattttgtcaaaggccttttctgcatctattgaaataatcatgtggtttttgtctttggttctgtttatatgctggattacatttattgatttgcgcatattgaaccagccttgcatcccagggttgaagcccacttgatcatggtggataagctttttgatgtgctgctgaattcgatttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccgcaatttcagctcctgttattggtctattcagagattcaacctcttcctggtttagtcttgagagagtgtatgtgtcgaggaatttatccatttcttctagattttctagtttatttgcgtagaggtgtttatagtattctctgatggtagtttgtatttctgtgggatcagtggtgatatcccctttatcattttttattgcatctattttattgtctctttttttctttattagtcttgctagcggtctatcaattttgttgatcctttcaaaaacccagcgcctggattcattaagtttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaagaatgtatattctgttgatttggggtggagagttctgtagatgtctattaggtccgcttggtgcagagctgagttcaattcctcggtatccttgttgactttctgtctcattgatctgtctgatgttgacagtggggtgttaaagtctcccattattaatgtgtgggagtctaagtctctttgtagttcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcaaactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgtggtggctggtaccggttgttcctttccatgtttagcacttccttcagtagctcttttagggcaggcctggtggtgacaaaatctctcagcatttgcttgtgtgtaaagtattttatttctccttcacttatgaagcttagtttggctggatatgaaattctgcattgaaaattcttttctttaggaatgttgaatattggcccccactctcttctggcttgtagagtttctgccgagagatccgttgttagcctgatgggcttccctttgagggtaacctgacctttctctctggctgcccttaacattttttccttcatttcaactttggtgaatctgacaattatgtgtcttgcagttgctcttctcaaggagtatctttgtggcattctctgtatttcctgaatctgaatgttggcctgccttgctagattggggaagttctcctggataatatcctgcagagtgttttccaacttggctccattctccccatcactttcaggtacaccaatcagacatagatttggtcttttcacatagtcccatatttcttggaggctttgttcatttctttttattcttttttctctatacttcccttctcgcttcatttcattcatttcatcttccatcactgataccctttcttccagttgatcacatcggctcctgaggcttctgcattcttcacatagttctcgagccttggttttcagctccatcagctcctttaagcacttctctgtattgattattctagttatacattcttctaaattgttttcaaagttttcaacttctttgcctttggtttgaatttcctcccgtagctcggagtaatttgatcatctgaagccttcttctctcagctcgtcaaagtccttctccgtccagctttgttccattgctagtgaggaactacgttcctttggaggaggagaggcgctgtgctttttagagtttccagtttttctgctctgtttttttcccatctttgtggttttatctacttttggtctttgatgatggtgatgtacagatgggtttttggtgtggctgtcctttctgtttgttagttttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctctttaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccagctgctttgtttacctaagcaagcctgggcaatggcgggcgcccctcccccagcctcgctgccgccttgcagtttgatctcagactgctgtgctatcaatcagcgagactccgtgggcgtaggaccctccgagccaggtgcgggatataatctcgtggtgccccgtttttttagcctgtcggaaaagcgcagtattcgggtgggagtgacctgattttccaggtgccatctgtcacccctttctttgagtaggaaagggaactccctgaccccttgcgcttcccaagtgaggcaatgcctcgccctgcttgggctcatgcatggtgcgtgcacccactgacctgcgcccactgtctcgcactccctagtgagatgaacccggtacctcagatggaaatgcagaaatcacccgtcttctgcatcgctcacactgggagctgtagaccggagctgttcctattcggccatcttggctcctccccagaagagatgttttgtgagcaagggtaagggaatacaatctggttttgtttcttagcagaaccagaagtagtagcagaataacctaacaaaaggatttatgaaatcagcggagataaattgggtgatgaagtcatctcatatttcttagggcaaatttttcaaatgaaggctctgcaccagctgtatctatttcatccgtatccacggtcaccattctgttaaaacctttgtcaaagcaatttcgggctaaattcccaaactcattgtcctttacttagtcctcattcttcatgaatttgatgtaccctctcacaagtattccttgatcttggtgatactatgctatcctaactttccttctgcttctaaaaattgtatctatattcctccttgtctctttttctcattttctatattcattctcttttaacactactttttaggatgcagttatacagtctcttatcatggcctcaaaaagtagataggtgatctactaatatagcttaacattccaagtggctgatggcaaatcttttctaaatgaaaaggggaaaattgaagcagagaggcactttgtaatttggtaagtgttaaaataatgtattaaagttgaatctagcatgaacttagatttctgattcccaggcctgtttaaaaacactttagaagatgttttcccaggtttattatgtgagcacatcttgagcatcttgagtacttttggcttatcagcatggtggctgcttgactaaattatccaattcttaacaaatcctaatagctcagaatatccatactgtttggtgaatgaaaatatataaaggaaacctagtaattcaatagggccaatgccatgagaagaccccttaaagtcctcttttttcttttttttatatattattattattatactttaagttttagggtacatgtgcacaacgtgcaggtttgttacatatgtagacatgtgccatcttttttcaagatctatgtatgtcgggagagggggcagaggggtgaaatttggagaaaaggaaggggaagagagggaaagagaaagaatgtgttcagatactacttttacccgttaaattgcttagccgtatattttatttaatcttagttcaatggatagcaaattaatcaggaaagaatattcagtgtgtgacccactcagtgactgaaataccctgctactaagagttcctaaatatatgcagtatgcataccttgtatattactaagaatatttgggcccaaaagtataacaaaacaaaggatgaatcacctggtaatcaacttttgttggtgttattgttctcagcttcatgttcttttacagaatagtatgtttcacatgaaacagtgtctgaccatcttcttggagcaagtagagcaaagcatctagatggtctgctctacactatcatatttaaacatactgctggtgccagcagttcagagtccctcatagaatttcttagatgaattgtaaattttgtcagctagtaatttcctcatggcttttttttttggtcacttaacaaatgctctaatttgtgtaatcttttcacacatatacccctcaaaacaggcaactgaagtagttatgataagtgaaacacagtgctttggttttcatttgaatacagtattgccttttaaagggcatatatgcttatagttaacttatgacagggaagatatgcctcctttaagcttttttactttttcttatgaaaaattcaaacatatacacaggtagattagtatgatggaatggactccccatgtatgtacacatcaccctgcttcaacaaatatcaattcatggtcattttttaaacaaaatttgagtttatgaagttagaaaataaattatacctaagtacttgatagaatgtaaaggtaatttggaaaggtctggagataggaatagtaaaaataataagaaacatttatatgttgatgacaagccctttgtcaattgctttgcttatgttaattacttctcacaaaatcccattttatgggaaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaatggagctttttgtttgtttgtttgtttttgtttttttttttttttttttgctcccgctttagcttataaggccaaccaaataagcagatctttctgaggatagcagttttaggcctgttatgctcttttctctacaagcaaagaagaggaagtttctctttatgtcagagcaaaacttttctcagaatcaaaactacctataagctgaagttccattgtcaagattggactgcttacccatactctagctgaaaaagaggctggaaaagctagtgtctcctatttttagcttctagcagaaggtgggttttagcagaaaagaaagagaaaatgggttaacttagggagggtagattcactcctggatgtagaaaactcgtctctggcaaaacgtctttacatgtgtcttggtaatgggcttactgtttgagcttgtgcttcctgcaggcttactatttgagcttgtgcttcctgcatttattcactcaacaaatatttactgaatgcttttcacttagagatgcttgagttgaaatctgaagggtgaatagtatttaattaggcaaagaagagagggaggtgactaaagagattccagacagaagaagtagtagcattaaaaaacagggtatattcaaaggaccatacacaagcacagataacaagaagagtggttgaaagaaaaaaaaaaaccttgctttgagatataggcagagctcagactctgtaggacattgtaggccatagtagtagtaaagttttcggcctttagccactgaagggctttaagtaagggatattgtgatcagcttcacattaaaacaattttaaacattttatttggaaataatttagacccacgagaagtttcaaaattagtaaggaagttccagtgtacccttcactcatattcccccagtaataatatctgaaataatgttaggacaattattaaaaccaggaaacagacactgatacaacactattaactgaatgacagacactttttgtattttatcagttagctatgaatttctaaaagactcctctagctacaatataaacaatgttttggaggactagagtgaatgcgtggagaccagtgaagaggctattgcagtagataaggtgagatgttggtggctcagactaggatgttggcagtgaagattctgaatattagattcaatagatatttgggaggtaaaataaagtgaactaggtaattcattggatgggatgttgaaagagagaaagtcattatttctaggtttctggcttggataactgaatagaaggtgatgctatttactgaaataaggactaggtttgtgtgtatggaggggcagagatgagtagctcacccttggatggacaggtagatctgttgagtatgcaaatgaatttgaaactctggagctcaaaagaggggctacatagtattctatagcatgatgtacaatgacatatttatttattttttatttttaaattctttgtagagttggggtcttgctccgtcacccaggctgcagtgcagtggcacaatcatagctcactacaaaagcttgaactctcgggctcaagcaatctccctgcctcagcctcccaagtagcttaatgggaggctaatccaccccaccacacccagctaattttattttttgtagagacagagtctcgctatgttgcccaggctggcatcaaactcctggcctcaactgatcctcctgcctcagcctctcaaagtgctacgattacaggtgtgagcaacagctcagcctctgacatacttaataactgttttctgttcttagaactttttccaaatttttcttcttaaaataaacataattgtagctaaatctttgtgtacatccttaatcattcctcaggataaattccctggagtaaaatttataggccaaataacatgtctattttaaataaaaacttatcaaatattgaaattattttccttctgtatgattctataaatcattaaaaacataatctgagtggcacaaggactgaggttcaagtgaagcatgggctgccacagtcagagccgaggtacaagcaaggtgcagactactgccatcagggctaagaggcaaggccactggggcttaggtgcaagcagcacatgcattccccacacactggcctaggctgtcacctctgaaggcagctgtgccctccccagtggcaaagccacagcatggccagtaccactcccaacctgaacatttcaccatgggcctggggatcacctcaccccatctacacactatcaggggcttgaggacaagcccacctggcccagctccgccccctcccccatccagaacatacagtccagggaccaggggattgcccagcccggtccaccaccgttaacacctcagaactcctccaggggtcctgaggtaggacctacccaccctgccactccaccacctgcatagcacttaccagcatagcacctacctacatagcacctacctactagcaccttccacctgtgggtctgaagactggctcagccagctcatcatagccaccaccaacaccagtgcacattgctctagacccagagggtcattctgccactgccactgacatcgcctaagccatgttggctgtccaggggcctgataacccacccatctgcctggcccactgttacaactaccaactactaacatctgagtaagtcatctggagacccaagaattggcctactaacactggagccaatgtatgccacctgggccccaagaatagaaatgctctgcttagtgctgccaccactaggagccaaagacaggaccacctagaatcccactactcagcaaaacttcaccacagcttccacaaataactacaccctaagccactgaggaaattacagatatccctgatgctgtttatagccaaagaaatcatacagagactacactgctgcacacgcccagaatcaaagccaaagtgccctgctcaaccaataccacagatacgtcttcaggaaaatgtccccaccatgaatgcaaattcaaaaaattggaagaagtgactattataccagatgtgcagatatcaaataaagaaacaggaaacatgaaaaagtaagggatgatgacatctccaaaggaacacaatgattctgcagcaacaactacaaataaaaaataaattaatgaaatctcagaaaaaacattcacaatgatgattttaaagaagctgagtgagatacaagagaataccgaaaaacaatacacagaaatcagaaaaacaattcaggatgtgaatgaagttttaccagagatagatatcataaaaaagaaccaaacaaattctggaactgaataatcacttgatgagatacaaaacatatttgaaaaccccaacaatagattagatcaagcagaagaaagaatctcagaacttgaaaacaggtcttttgaaataacccaatcagacagaaatgaaaaatgaagaaaaaagaacaaaaaagaataagcagagctttttttatatgtataggacaccataaagtgaacaaatacttgagttatctagaaggcaagcggataataaaagggttagaaaatgcatttagcaaaacagattttataaataaaacttcctaagactagcaagagatttagacatccaggtacaggaggctcagaggtccccaaacacatacatagcaaaaagatcttctccatggcacattgtaggcaaacattctaaagtcaaagagaataaaataaaattaaaattgaattaaattaaaacagcaagagaaaagcatctagtcacctataagggagtcgccatcagactaacagcagatttctcagcagaaattttacaaaccagaaagaatgggatgatatattcaaagttctgaaagaaaaaagctgctaatcaaaaatactatacccagcaaaattgctgttcataaaagaagaagagagacagacaaaagatgagagactttatcaccactagatctgccctaagaaagttctcaagggagtcctaaacctggcagtgaaaggattacatttaccatcataaaaacacacatagttataaacctcactggtaaagcaaacacacaaatgaggcagagaaacagctcaaacggtaccactacagaaaaccaccaaaccataatgaaaaacaagagaaaaagaaaggaacaaaggatatacataacaaccagaaaaaataacaatatgccagaaacaaaccctcacatactaataataaacttgaatgtaaatgtattaaattctccacataaaagatatagactggctgaatgtatttttaaaaaacatgacctaactatatgctatgtacaagaaatgaactttacctgtaaagacacatataggttgacagtaaagacatggaagaacgtacatatcctactcaaatgggaaccaaaagtgagcaggagtagctatacttatagcaaataaattagagtttaagtcaaaaacagtaaaaaaggcaaagtcactataaaatgacaaagggatcaatccagtaggaagatataattgaaatacatacacacctaacactggagctcccagattcaaagagcaaatattactagatctaaacagagagataggcttaaatgcaataatagtgggggacctcaacattccactctcggtattagacagattatctaaatagaaaatcgacaaaaaaacattggatttaaactgaactctagaccaaatggacctaacagacatttacagaacagtttatctaacacctacagactatacattcttctcatcagcatgtggaacattctccaggatagaccatatgttaagccacaaaacaagtctcaacaaatttttaaaaattggaatcatacaaagtatcttctcagaccacaagagaataaaactagaaatcaataccaagaggaactttggaaactctacaaatacctggaaattaaacaacatgctcctggatgaccactgagccaatgaagaaattaaaatggaaatcaaaaaatttcttgaagaaaatgaaaacggaaacacaatataccaaaacctgtgggatacagcagaagcagtgccaagagggaagtttatggcagcaaatgcctacttcaaaaaagtagaacagaactagaaaaggaagaacaaaccaagccaaaattagcataaggaaagaaataaagaccagagcacacctacagaaaatagagactaaaaaaatacaaaggatcaataaataaaaagatggaaaataatcctaaaatttatatggaaccacaaaagacccagaatagccaaagctagcctgagcaaaaagagcaaaactggaagaatcacattacctgacttaaaattataccacagacctatagtaaccaaaacaacatggtactggcattaaaacagacacatagaccaagggaacagaatagagaacccagaaacaaatctatacagtaaattaattttcaacaagtgtgccaagaatatacattggggaaaggatggtcttcaatgaatgacactgggaaatctggataaatatatatgcagaatgaaactagaccccaatctctcatcatacacaaaaatcaaaatggattaaagacttaaatctaagacctcaaactatgaaactactaaaagaaaacattggggaaactctccagaacattggactgggcaaagattttttgagtaatgtcccagaagcacagccaaccaaagcaaaaatggacaaataggatcacatcaagtttaaaaagcttctgcacagcaaaggaaacaatcaacaaagtgtaggaaaccccacagaatgggagaaggtaatatgctgggactgatgaattaatccattgtcaatctgacaatggattaataaccagaatacataaggagcttaaacaactctataggaaaaaaatctaatgatcttatcaaaaatgggcaaaagatctgaatagacatttctcaaaagaagacatgtaaatgtccaacaggtgtatgaaaaaatgctcaacttctaatcactggggaaatgtaagtcaaaaccacaatgggatatcatcttaccttcagttagaatggctattactaaaaagacaaaaaaaaaaaaaacccacagatgctggcaaggatatggagaaaaggaaacttttatccactgttggtaggagtgtaaattagcacagccattgtcaaaaacagtatgcagatttctcaaaaaaaaaaagctaaaaatagaactaccatatgatctagcaatcccactactgggaatttatccaaaggaaaagaaaccaatatgtcagagatacatgcacgctcatgtttattgtagcgctgttcacaataatcaagatacggagtcaacctacgtgtccatcaatggatgaatggagaaaatgtggcatgtatacacaatgtaatactatttggccatagaaaataatggagttattccttttgcagcaacatggttgaaactggaggtcattatgttaagtgaaataagccagacacagaaagacaaatactgcacattctcactcatatgtgggagctacaaaagttgatcacatgaagatagagtggaatggataccagagactgggaagggtatatgggtggaagcggggagcaggggatgacgtggaagggatgagagattggttaatgagaataaacatacatacttagttaggagaaataagttctaatgttcagtagcagagtagggttactatagtaaacaacgtgttatatttttcaaaatagctagaagagaggacttgaagtgtacccaacacatagaaatgattaatacatgggtaatggataccctaaatactctgacttgatctttacacactatgcatgtaataaaatttcatgtgtaccttataaatatatacaaatataatgtatcattttttaaaaaataacctgatgcctcattagcctaggcatggaacaaacttcagtgttctaagaggggctggagactgatgaataatgagaaagctgagaaaattatacaaaacaaaagtagtatctgaacttctatcagccaccaatatagtatgttgtgatattaaccatcataatccatttgttaccacattttaaaatgtaaactattagagaatttctctaccttttgggatagtaaattttgtttctatagaatttattctgtattgaacttttactgttccttaaagcaaggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacattgtgtgtacattgttttgagttcattattctatccctggctaccaaaatatagacagacaggtgctaggcctacatagaaggttctacatgatttggaaccagccacctgtacttaaagaactgaaccaagcaaacttaagtgatcacagggaagattctgtagttgctaggtttttttttccccctcttggtatgttaagatttatatgggtggctgaaataattatgtacagctgatacagatactaagattttttagatgtatccataccaacccttctgtgaatattctctgtattagaatgcatcttgtctttttagcatttgaaaaagataattcaggggttggtattttttcaaagcttgctttagaaaaatggttgacataacatgcatgatacctaacgtcactcagtttttttggtttttttttaagactttagttttgattttttcatgaaatgttgaagatgttttaagtgtgtagtgaataacttttagtgttttttaaaacttaggccctctgattaatattcagtttgtccataaataggccttatcaatccattctattaccctttacaaaaaccctttgtttcatttaagtgggtctatctctctatcccttattttaattcaaatattccattgtgaaattttgctttcttggcaaattccaacaatgcaaaaactgcagttacttttgctgtcgccgtaatgtatggtgatcagatcagggtaactagcatatctatcatctcaaacatttattatttctttgttttggaagcattcagtagcctccctttagctatttgaaactatatattattgttaactatagtcatcctacattggtgtagaatactagaacttattctcctatctagttgtaattttgtatccttttgcaaatttctccatatccctcccttccccctccccttcccagcctctagtattcttcttttctactttccacttttatgagatcaacattttaaagtttccacatatgagtgagaatatatggtgtttaattttctgttccttatttcacttaacataatgtcctctagttccatccatgttgccacaaatgacaggattttcattcttttttatggatgagtagtattccattgtgcatattataccaaattttctttatccattcatctattaatggatacttaggttccttccaaattttggctattgcaaatagtgctgcagtaaacatgggggtgcagatgtctttctgatataatgacttccttttctttggatcaattcccggtagtgagattgctagatcatatggtagttctatttttaattttttgagaaatcttcatattgttcttcatagtgtctattgctctcaattgccactatgctaatttatatttgagaaagaatgtgattcactttctaatatttcttcaatagaaagtagataagatttctgattgtttcttaacaatcttctcaaaagattgcagaaatcacagttggaaacagagatattcagtctgctaagatggctgaggttatactttaatcattgtttatacatctatgaaatattattataggaggatgtcaactaccagttttccttctcttgtgaagacaaagctaaaagaaacaggtttaaactatattggtagtgttaggttacatataacaaagaaatgctcaataatgaggtttgttagatactagattagtcaacaaaaaaagatagctgaatttcactcatgggaaaatccttatgaaataggatagataatcatctaacatgatcggctagtgggaatgatcttcatgtaactaaatggcctcttaggactccttccaaactctgaattctgtgaaaataatgtaattaaaacctgtttccaaaataaatatatagttattaatactacatagaattgtttaataagtttacaataaatgtctaccacattggcaaacaaatctagaataccctggagccatgttataacattgtcatagaatctttgttattggtattgttattgttgtttaagttggaacattaatagatgaggaaactgaggatcagaggttaagggacttgcccaaggtcataaagtagcactttcaggactaaaacctagctttgtatttctacttctggttcaaagctttccatctcatcaccctcctgaccttgggcttcctgttctgggagtgcttagaggtgaggctgagatatgtcctggagaaacttacttaatgtcaattatgttctgtatcaaatagaactacaagaaatctaggagaagcttcagcaaccttgaaattaaggaacactggttttctctgcctctggaggggccagagtagttatatatagtcagtctccttcactacattcaaaggaaccatatctgcctttgctcattgctgaaactatagttcttgacacaaaggtacgaaaatatctgttaaatgagtgaatggatataaatgaaattaactttctttattttataatcagacataaattttgtactaggccactggctatttgtaaagctgggtatatcctctcttttatttttcaaaaggcctctccaagatatatcttttttagttttatttttttacctcctctgcttaggaaagtaagacaaaactaaacttaaaaaacaagtttcactttttcccaggtaggagcttccatgttggtttgcctcttgtggtagagtcaaatttactgcagcaattaacaacatgttgtgctattaaatcaccaccaacacaaaatgctttaattaagcaaccatgtgcccaagatgctgattgaaattaagcagctgtggttcctgcttgtagtctaactcagacaatactgatcaggacatgctgtatgtgtaaaaggacccaaaacttgaacaaatgacaaatagtaagttatttacatacatgaatttgagttggtatataatacactctgatataggaagatccagtatacaagattttgaattttaagatgaactaactgagatttaggttatagcatgtctgccatttatttactacctactatgtgcaagacattatgctgggggctctctatacttactttctgaattttcacaaaaaccctgtgtgattggcattatcctccgtatacagacaaacaggcatggagaagtaaagtaattactcattgccacattgtaaataaggcggaattcaaggccaggttacctgaattgataatctattatatttctattgtaccatcctaccttttccagtgtaatgaaaggaatactggataagtaatcaagatatctgaattttagactttgttctgtcttgggaaagtcaactaataactctgactttagattttcttttttatataatggggaaagatcatttattgtctatgttagggcatgcctgtggtgacagtacttcctatatgaatagtctcgacttgttctaccaatagaagagagtatttaatattgggattatcaacatatctgagactcttttgtatttagttggcagtacatatttatctaacaaaaatttgttgggtacttaaaatatggaaggcactgtgctatgtgatagagatacactgatgtggggaaacaaaaagacaatgtaccccaccttcatggagcatacaataatttagtgggagacacagacattaaaaacctaccaataaatgtaaaatttacaaatgggttacatgctacaaaagagaagaatgtgattccatgaaaacatgatatcgtaccttgactcacatgacaatgaagagggcttagactgagatctgaaggaggagtaggagttatctagacagatggtagggggtaagagagttccaagcagaggaaatggcatgtgcaaggtcctatggtagcaaggagcatagagagtttcaacaaatgaagagtcaagtatagctggaacatagaaagaaatagggagacagtagagcaagaagaggcttgagggtaggtagagtctaaactatgccagggctcataggccatgttaagatcttagttaagctctggttaagtttagcttactttggactttatgaaaaagaaatgactcgattttttattgtatacttatgtttacccagtgattttacaaagaaattttctagttatataccatccacattttaagcagttaaaaagagtaaacatagttggaaatgcgacttagaaatgaatgacatatatttatgaatggaaactaggaagaaaattctatagatgagaattaaaatctgtgacacatagtatcttaagaggattcaattcactaagtaggcaaaattttaaatgtaacatgtattttttggacagctattataaaagatactgctaaataagaaaaataatgccatatctgggtaagagctattgctggtaaaagtgagagaaagaagaaaatggttgtgtgctagtgtagtctgggacaacatgatgaagatgattatagttgaatttacccctggatactggatatggactacaggaggagggcacactagatacctctattgtgtctcaaaaacacaaataataattttagattttggagagtaagaaggaggaaatagatttcttagcctttgcctcttttaccacagttttttcatccagagtaatctaaagacaagttggggagttatttcctagaccacatcctgtgtgtgtctacctaccaatcacttctaatgccatagactttcaatttacaacagcatcttagagatcatctggtctacttcctttatttaataaattaggaaacaggctcctgtcaggcattgagtcagagttatcagtgtccacccatctgatcgctaacagaatatttggagagatatcatttaaagagagaagcagggacagaaaatgaccttagtgtgtcagtataaagaatacaaactttggaatcagaatgcctatcttcacagttctggtactgccagggaccttgaataaattacttagtatctctgaacttaaatttcctcaagtgtaaaatagggctaagaaaagtacttcctttacaagtgggcataaggaataaatgtgattatgagtaaaagtgttttgtagtcaaaatgtaaattatgaaaccttacgtaaatataaatttctgtgctgacagaatacaccaaaccaaattgtacagccagtgacagcaactgtactgaatagtgttgtgttttggcttcctcttttttcttctccctattttgttaatcttattgtttttattgtttgtatattatatgtttattgtatgtatattataaatttattgtattcatctattactgggaaaggatacaaattacaactagccaaaagaatagtcccatatggcagagttcaggaaggttccaatcatgaagcttccattatcctcaggacatgttaccctcctagcatcaatatgtatcagtacacatggagtattgccaacttaggaagctcacctaagctttagtgttcagactttttgttgaagattaattacataggcatgattgattcatttattgcccatgtggttgaactcagtgtttaggtcaactgatactgcatgactcaaagcctccaacctaagtcacatagttgatctttctgatgtggccagctcccacctaaagactctcaggtttgtaatgtcataactgtgctcctgaaagaagttggatgtggttaagatcttgctggtaaatgtcttcgatgatagtgccgttgaggtaccccatgagtagcaagataaggtatgttttattcctttcaaggtgaagacaaactgcaactgagaggctattcaaatagacactaaatattaacaaaaatctataaaagcaaaataatttttcaatagttaattgagtggagtcaatattattggctatgggccttaatcagtagtattatggcattaaggttgcagtagcccactgttaagtgccattcattttcattaggtttgggcattagccatattgggctcatcaagaaggcagcaggaataatagctgcttcttttagtaggtcttgtataatgggtcttatttcttgtacgccttgtttctatctatattgggccacatttactattttaacctgatggtggtggtggggaggtccatggggtaccatttgtcaagcttattttaagtgccaaatacttaatattgtttaaatttgttactctttgggtcagagcatcaatgctcactgtattagtctgttctcacactgctataagctacccaaaactggtaatttatggaaaaaaagaggtttaattgacgcacagttccaccgggtgcacaggaagaatgtctgggaggcttcagaaaactaacaatcgtggcagaaggcgaaaggggaagagagagagcaaagagggaagtgctacacacttttaaacaacgagatctcatgagaactcactatcatgaggacagcaagggggaaatccactgctgtgatccagtcacttcccactgagtccctccctccaacatagggaattacaattcgacatgagatttgggtggggacacagagccaaaccatatcacttccactgggatattttaggtcaatgagcactatgaccctgaggaatttaggcaaggtaaatgttaaggtgaggcatacctgtttgtcctctattttatatttggcaactccccgaatagtataagaagtactttgtttaaaaatttaatgtgatctcctaacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttcctcctccatatcaagatttcttgttggccaggtgcggtggctcacacctgtaatcccagcactttggggggctgaggtgggcggatcacgaggtcaggagttcgagaccagcctgaccaacatggtgaaatcccgtctcaactaaatacaaaaattagctgggcgtggtggtgcatgcctgtaatcccagctactcaggaggctgaggcaggagaattgcctgaacctgggaggcagaggttgcagtgagccaagatcgtgccattgcactccagcctgggtgacagagcgagactccatctcaaaaaaaaaaaaaaaaaaaaaaaaaaaaaaaaaaaaaaaaaaaaaagattttttgttttatttttgtggttattggacattcatcaaggagagagagtcctctctccctgctcatatttataagtttcttcctccagagagttgcaattcagtatcatcagggttaagggcctccctgcggtgattgttgctctattgggtttaagaaacctgggctggctgggcacggtggctcacacctgtaatcccagcactttgggaggtcaaggcaggtggatcacctgaggtcaggagtttgagaccagcctggccaacatggtgaaaccgcattctactaaaaatacaaaaattagctgggcgtggtggtggccacctgtaatcctagctattcaagaagctgaggcaggagaatcacttgaacccaggaggcggaggttgcagtgagtcgagatcacgccattgcactccagcctgggcaacaagagcgagactccatctcaaaaaaaaaaaaaaaatagaaacctgggcttcggtgagatttaatttaatcctttggcatgttgacaagtcacagccctcaattgaacccagagtttttgttggtcatttttatagttgtccattagggtgatagtttcctctggacatttaaaaggagtaagggtaaaacatttggggctgtcttctataagggcttgtgccactggataacatgggcatctttttatagccttgaggaccagaatctgtttggatggcatacgcagtagcagcagtagcaaaggcatcatacagtcctagttagccatctgatttttggagtgtagacttcaacatgccacatggtgactactctgcttcatataatcaactaaccaatgggcccatatatagtacaagatgtagactttcccctgagcactctataaaatggggaccaaggcctcattaaggcatacaaccaatggtcatagagtaaaagtcctctgcctgagcctagcatcaatcatgccttattctagaattgagacacatgattcaaactgaaacactcataaaggcctgggccaatatgcgtgacccagggctactctaagtagggccccaataccatattcctatccctaaatgtaaatcactgaaacttattaattaggtagattaaatctataacagagtcttggtaggagttggcatatgcagtacagcacagcacaactcatagtgcaggctgaccagcaggcagcagcacatttcaaagtgtaccctggccagttagcaagccaaaagcaagagaagaaagacccctaggtagtgatggttattgccctaacatcctcctcacggtgccaattttcttgtggttgccctgcaagaggggataattcccctcacccaaaatgtggtttggatgtcaagaccaatgatgccacacatgcagtaaaaaaggcatgagaaggtttattacagacataatgaggttttctggagagagcagggatggctcccaagccaatctgaaatggcttcagtgaagagaatggcaagtatctttggtttttattgtggttaggtggtggggccaaggtgaggtttcctgtgctggttgtgccttgtgtggtttgaactttgaggcttgcaccatgggaaagagttaccaggccctcttatcaccttgtcctgatgtgggacaaaaaggggaagggacaggagtggggcttgaaagctgtcaccaattatacaacaaaaatatactcaggctctttattataattttcatctctaaaaataaattccagtgccaccagtaaaaggaaaagtagaagcttaccagctaaacaagatggctaaaatgaaaacatgttcagtttcttttaaaaagctactagtgttttttaaaatatcgatgttagtaatctcagatttattcttcttaaatttatcagccttctttttgatgctgtactgaaaattaagatgtagtagtgatatccactctcttccactatgtaattctatttttagaagtcctatgtagctttaatgctatgctttattttgaaaatatagttttatttataaagatttcttatctgtctttggataaaaccaaatattgcctcacagaagctgagacctctggtctgcatcagtgcacttgtattctgtaccacaaactaattgtgcttcttggaaaaatcatttgttctgtgcattagattcttcatctgtaaatttgttcatccaatgtctgctttctatgagatagactttgaatgaggtgttgagggtacagaactgaataaggcatggtccttgctcttaaagagctcacagtctggtgggggacataaatgtctgcaattacaatatgatacagtaattgtcatgatagaagtctgcaggtggtcctgggaataatagtgatatggataatacctttactaggtattcttcactaggaggggaataaatggagaacaaccatgttaaagtactttgagatgtataatgtgaaacaaaatcacaaatagatacccaacttcatttcatctaatttattcattttgagcttaagtacttagagcttttggtactcttgaaatgtatttttggaattttggaattactgtgggactgtatttgatgcgtttctaattaagatttatttttagtttttgatggtcatattctccagatgatgaaactgtgtgttcttcttaccaccatggttgagtgcagctggggcaaatgacacaactggcagactgctaatactataaaattatggtttctaaagacctcagttgggcccgcagagcaccattcagtaatccttttatgtgttcttaattattcccctctcctgttgacaggggctactaccattgcaaaccttgactacctttctcatgagcactgctccacacattctcctcaatatgagccttgccagccagtcttaccagtcttaccttctgtcattctcttaagacacagttatactgcatttctacctaactattgagtgagtcatgctgctttaggtctctgtacctttgtacattctattcctctgatgggaatccatcaccccacaccaaccttaaccagcttctatttttttcaagactcagctcacatatctccactctctgaggccttctttggcagcccaagcatagttagccactccttcatttgcatcaccactagacatagtattttctgctgttatagaatgtagcatactctattatacttgtttactttcttaattttctcctctaataaactgtcaagtcctcaagaacagggactatctatcttcggtctccagcacctagtataatgttggcacaaacataaatatttattgagagaggaaaggtaaggaaacaacataaatattagacatatacagcttctttcagaaagcaaaaccactgttttattaatttcaatcttttaagctaatttgcagtggcataccccagtttcctttttctctcaacctttaggaaaatttctttcaatttaatagaaagatgctgcatttaaaaaaaaaaaaactccaacaaagacagctgtctgacagctgtagaccatctgtgctttcagtcctgggtaaaaacatctggctacttgagaatagaagctctgtagtaaagcagtttcctagactgatggtgattagtattctacaaatatgccttgcattgtcccactttgacatgatataatgtacacaacttgtccctctaaattatgaagtttctttttgcttgtatacctcaacgaaggttaacaaacaacaaaaacaaaaaatgaagtgttatcatgttgctacattttggccatgaaaactgcttttgtcataaaagacaacatcacaaaaagtaagtgatgaatccagaggagtgtgcatatgtacccatacatttatgttgttaggcaaccgtctataccacatatgaatttctcctcaaacaaaatattcagactaaatgccaaacatccttttctatgtttcccagatttggaactacctcagggactatttccatttaaaaagccatggaagaaataaagtataaaagacctggttccatgtatcaaaatacctgcagttctgtctagctatatttaaccctccttgatcaactaataagtttcctcttacttatttgtacagaattctgaaaaatatcatatcaattacatgagtagcatcatatgcacacattctatttcaaatgttcagtctttaataaagctgtgagtagcgggactgatccaagatggtcgattagaagcagctgcagtttgtggcactcacagagaggaatgaaaaggggtgagtgaattcagcaccttcatctgaaatatccggcttctcacactgggactgactaggtaaacaacttgaccaacagagaatgaagaaaagcaggatggggtgacagcccacacaggagcagcacagaaccaaaggaacccccatccccagccaagggaagccgtgagtgattgtgcaaccccacacaagaaaacatgcttctcccatggatctttgcaacccatggatcaggagatcccctcgtgaacccatgccaccagggccttgggtctgatagacagagctgtatagagtcttggcagaatagccactcaggcatacacagagacccaggagttttatatactttggccctgggattcccagcaaggcaggaaatccgtccgtacctatccctaggaaaggggctgaatccagggagccaagcaacgtcattctttgggccccacttccacattatctcacaagttaagacccacaggtttggaattccagctagccaatggcaatgggctggagtctgactgagacaagtccaagttcctggggggaggggaagttgccatctctgcagttcagtcgactcagctgctccagcctgccggctttggagagtccagatgttccagaggaggagaggtcccccacaacacagtacagctgccttgccagattgtggccaaactgcttctttaagcaggacactgatccattcctcctcgctgggtgggacatccctgcaggagcttcagccacttcagccaggattctatggacagagctatgatctctccctgggacagcttctggagttggggtgggggtggggggtagccgccatgtcagcagttgggtagactcagccgttccagcctgctggctgtggagaaaacagacagtctggacgaggaagggtccctcacagtgcagcacagctgccttgccagatcttggccagagtgcttctttaattgggaccccaatccatttctccacactaggtgggacctccctgcgggggcttcagccacaccagcaagggttctacagacaaatctctgatctctccctgggacagagcttctgggcataggggcggctgccacctccacagttcagttgactcagccgctccagcttgctggctgtggagaatacaggtggtcttgatggggaaggtcccccacaacacagcacacttgcattgcccaaaagcagccagactgcttcttagggcaggtccctgatccagttcctcctgactgggtgagatctttcaactataggaggtggtggatctccagccacctcctttaggtttgtgcaggacagcaagaggtcagtagccccctgggatggagctaccagaggaagggggtggctgctgtctttgctgtttcatggcctttactggtgataactccaggcatgggacaaaccaaggcaactggggtctggaatggacccccagaaaaccatggcagccctgaggtagagtggcctgactgttaaaataaaaacaaacagaaaacaacaagatcaacaaaaaggaccccacaaaaacctcattcaaaggtcagcaatgtcaaagatcaaaggtagataagcccacaaagacaagaaagaatcaccaaaaaattgctgagaactcaaaaagctagactgcctcttctccaaatgactccaacacctctccagcaaaggacacagaactgagctgaggctgagatggctgaattgacagaagtaggcctcaaaagctaggtaataatgaacttcgctgagctaaaggagcatgctataacccaatgcaaagaagctaagaatcatgaaaaaacaatacaggagcagatagccacaataggcaatttagagaggaacataactgagctgatggagctgaaaaacccaaaacatgagaacttcacaatgcaatcaaaagtatcaatagcagaatataccaaacagaggaaagaatctcagagcttaaagactatctttctgaaataaggcaggcagacaagaatagaggaaaaagaatgaaaaggaatgaaccaaaccatccgagaaatatgggattatgtaaagagatggaacctatgactgattggggtacctgaaagagatgagaagaatgagaagaatggaaccaacttttaaaacatacttcaggatatcatccaggacaacttcctcaacctagcaagacaggccaacattcaaattcagaaaatgctgagaaccccaggaaaataccccacgagaagattgaccccaagacacgacacataatcatcagatttccaaggttgaaatgaaagaaaaaatgttaagtgcagccagagaaaaaggccaggtcacctacaaagggaaacccatcatactaacagcggacctctcagtggaaaccctaaaaagccagaaaagattggggccaatgttcaacattctttaaaaaataaaaagaaattctaacccataatttcatatccagccaaaataagcttcataagcgaaggagaaataagatccttttcagacaggcgaatgctgggggaatttgttaccatcaggcctaccttgcaagagctcctgaagaaagcacagaatatggaaaggaaaaaccattaccagccactacaaaaacacactgaagtacacagaccagtgacactatgaagcaaccacataaacaagtctgcagaataaccagctagcatcataatgacaggattaaactcacacataacaataataaccttaaatgtaaatggactgaattccccaattaaaagacacagaaaggcaagctagataaaaagccaagacccattagtatgctgtcttcagcagacccatctcatgtgcaaagacacacataggctcaaaataaatggatggaagaaaatttaccaagcaaatggaaaacagaaaaaagcaaaggttgcaatactagtttctaacaaaacagattttaaaccaaccaagattttaaaaaagacaagggcattacataatagtaaaggattcaatgcaacaagaagagctatttaggtatcttaaatgtatatgtgcctaatacaggagcaatcagattcataaaacaagttcttagagacctacaaagagacttagactcctgcacaataatagtgggaagctttgacaccccactgacaatattagacaggtcattgagacagaaaatttcaaaaaaatattcaggacctgaaagtcagctctagatcaagtggacctgatagatatctacagaactctccacctcaaaacaacagagtatacattcttctcattgccacattgtacttactctaaaattgatcacataatcggaagtaaaacactcctcagcaaatgcaaaagaactaaaatcataacagtctcttagaccacagcactatcaaattagaactcaagattaagaatttcactcaaaaccacacaaccacctggaaattgaacaacctgctgctgaatgactcttgggtaaataatgaaattaaagcagaagtcaagaagttctttgaaactaatgagaacaaagagacagtgaacctgattctctgggatgcagctaaagcagtgttaagagggaaatttataccactaaatgcccacatcagaaattcagaaagatctcaagttagcaacctaacatctcaactaaaagaactagagaaccaagagcaatccaaccccaaacctagcagaagacaagaaataacgaagatcagagctgaactaaaggagatagagacatgaaaaaccctttgaaagctcaacaaatccaggagctggttttttgaaaatattaatgaaatagactgctagctagactaataaagaataaacatgagatgaatcaaataaacacaatcagaaattataagggggatatcaccactgaccccacagaaatacaaactaccatcagagaatactatgaacacctctatgcacataaactagaaaatctggaagaaattgataaatttctggacacatacaccttcccaagactgaaccaggaagaaattgaatccctgaacagaccaataacaagctctgaaattgggtcagcaataaatagcctaccaaccaaaaaaagcccaggaccagattgattcacagcagaattctaccagatgtacaaagaagagctggtaccatttctactgaaactattctaaacaattggaaaggaaagactcctctcaaactcgttttatgaagccagtatcatcctgataccacaacctggcagagatacaacaacgaaaaagaaaacttcaggccaataaccttagtgaacgttgatgcaaaaatcctcaataaaatactgacaaactgaatccagcaacacatcaaaaggctaatccaccacaatcaagttggctttatctctgggatgcagggttggttcaacatatgcaaatcaataagtgtcattcatcacataaacagaactaagaataaaaccacatgattatctcaatagaagcagaaaagtcctttgataaaatccaatgtcccttgatgttaaaaactcttaataaactagatgttgaaggaacgtacctcaaaataataagagccatatatgacaaacccatagccagtatcatactgaatgggcaaatgctggaagcatttcccttgaaaaccagcacaagacaaggatcccatctctcaccactcctattcaccatagtattggaagtactggccaaggcaatcaggcaagagaaagaaaggaagaaataaggatattcaaataggaagagatgaagtcaaattatctttgtttgtagatgacatgatcctatatctagaaaaccccatcgtctaagcccaaacgctgcttaagctgataagcaacttcaataatgtctctggatataaaataaatgtacaaaaatcaccagcattcctatacaccaacaacagggaagcagagagccaagtcatgaattaactcccactcataattgctacaaaaggaataaaatgcctaggaatatggctaacaagggacatgaaggacctcttcaaggagaacttacaaaccactgctcaaggaaatgagagaggacacaaacaaatggagaaacattccatgctcatggataggaagaatcaatatcttgaaaatggccttgctgccccaaagtaatttatagagtcaatgctattctcgttaaactaccactgacattcttaacagaattagaaaaaacttttaaaaaattcatgtggaagcaaaaaaaaaaaaaaacaaaaaacacccaaatagccaagataatcctaaacaaaatgaacaaagatggaggcatcaggctacccgacttcaaaccgtgctacaaggttacagtaaccaaaacagcatggtagtggtacaagaccagacacatagaccaatggaacagaatagggaattcagaaataatactgcacacctacaaccatttgatctttgacaaacttgacaaaaactagcaatgggaaaatgactccctatttagtaattggtgctgagagttctatctagccatatgtggaaatttgaaactagaccccttcgttacaccatatacaaaaattaactcaagatgaattaaagacttaaatgtgaaacccaaaactataaaaaccccagaagaaaatctaggctgtaacattcaggacattggcacgggtaaagatttcataacaaaaacaccaaaagcaattgcaacaaaagcaaaaattgacaaatgggatctaattaaactaaagagcttctgcacagcaaatgaaactaccaacagagtaaacagataacctacagaatgggagaaaagttttgcaatgtatccatctgacaaagctctgatatccagcatctataaggaatttaaacaaatttacaagaaaaaaacaaccccattaaaaggtggtcaaaggacatgaacagacacttctctaagaagacatacatgcggccaacaaacataaaaaatgttcaacatcactgatcattagagaaatgcaaatcaaaaccacaatgagatatcatctcatgccagtcagaatggctattactaaaaagtcagaaataacagatgctggctaggttgtggagaaaagggaatgcttttacactgatagtaggagtgtaaattagttcaaccattgtggaagacagtgtggtgattcttcaaagacctagaggcagaaatactatttgacccagtaatcccattactgggtatatacccaaaggaatataaatcattctattataaagatacatgcacacatatgttctttacagcactattcagaacagctaagacatggaatcaacctaaatgcccatcattgatagactggataaagaaaatgtggtatatatacaccatggaatactatgcagccataaaaaggaacaagatcatgtcctttgcagtgacatggatggagttggaagccattatcctcagcaaactaacacaggaacagaaaataaacattcttattcttataagtgtgttcttataagtgggagggttatgatgagaacacatagacacatgggtggaacaacacacactggggcctactgggggggatgaggggggtgggagagcatcaggaagaatagctagtggattctggactcaatacctgggttatgggatgatctgtgcagcaaaccaccatggcacatgtttatctatgtaacaaacctgcacatcctgcacatgtgcccctaaacttaaaataaaagctgaagaaaaaaaataaaaaataaagctgtgagtagctatcaacaatagtatttgaatttccaaaattttcaagtaccatatatctcagatttcacaactttgatcttaaatggttagtctcactaataataatttaaaagtacttgaatttatgaattttgtaattaaccttcattagcttaactttaatattagcacaaaattaacagcagttcacatttcagtaccgagatcttgatgtgtatgtgtgtgaatgtgcataaagataaagaatacagatgtaagtcagatatgccagcaagtggttaataaaatgtggtagcatggcatttgtgcctagcttatttgcatcagatttactcttctgggtgcctcttggatgtttttcagtttttttaaattgttataagatatgtgtaacataaaatttaccatcttaggcatttgaaatgtacagtttggtgttactaaatacattcataatgttgtgccaccatcactaccatccatctctataactttttgtcttgtaaaactgatcagttgaacatacttggtgagtatgccataacttttttactgaaaattgggaggccaggcacagtggctcactcctgtaatttcagtgccttaggaagctgaggcaggatgattgcttgaggccaggagtttgaggccagcctgggcaacatattgagaccccatctctacaaaacacgttttaaaattagttacgtatggtggtgcacgcctgtagtcctagctacttgggaagcagatgcaggaggatgacttgagccaaggagttcagggttacaatgagctatgatcatgccacagcactccacctccagcctcggcaacaaagtgagaccctgtctctaaaaaaattaaagaaaattggggccctaactttttaccttcaaaagtttgtaggtatgtccagagatagtgtgattttaaagtgacttactgattaactgtagtgtgtctggaggaagcataacttatagatgaactggaagccccaaacagtggtcaaaggacatcagtgctagagaagagcattgagggacaatatagtacttccctttgaaagggcagaactcaagtcaacgagggtgagtgccaaaaagccactttcagatcaatgtaagaagaaactttctagcagatgccttaaatacttaagcagtagaatgatgattgtctgtatggaatatattgtgtggaagattagactaaataagttctaacatcctgttgttatgttattctatttttttaatttatttattattattatactttaagttttagggtacatgtgcacaatgtgcaggttagttacatgtgtacacatgtgccatgctggtgcgctgcacccactaactcgtcatccagcattaggtatatctcccaatgctatccctcccccctcccccaccccacaactggccccagagtgtgatgttccccttcctgtgtccatgtgttctcattgttcaattcccacctatgagtgagaatatgcggtgttttgttttttgttcttgtgatagtttactgagaatgatgatttccaatttcatccaagtccctacaaaggacatgaactcatcattttttatggctgcatagtattccatggtgtatatgtgccacattttcttaatccagtctatcattgttggacatttgggttggatccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgactgccattctaactggtgtgagatggtatgtcattgtggttttgatttgcatttctctgatggccagtgatggtgagcattttttcatatgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtacagaagctctttagtttaattagatcccatttgtcaattttggcttttgttgtcattgcttttggagttttagacatgaagtccttgcccatgcctgtgtcctgaatggtaatgtctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcaggctcttttttggttccatatgaactttaaagtagttttttccaattctgtgaagaaagtcattggtagcttgatggggattgcattgaatctgtaaattaccttgggcagtatggccattttcacgatattgattcttcctacgcatgagcatggaatgttcttccatttgtttgtatcctcttttatttccttgagcagtggtttgtagttctccttgaagaggtccttcacatcccttgtaagttggattcctaggtattttattctctttgaagccattgtgaatgggagttctctcatgatttggctctctgtttgtctgctgttggtgtataagaatgcttgtgctttttgtacattgattttgtatcctgagactttgctgaagttgcttatcagcttaaggagattttgggctgagacaatggggttttctagatatacaatcatgtcgtctgcaaacagggacaatttgacttcttcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacgatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatctgtggtgatatcccctttatcattttttattgcgtctatttgattcttctctctttttctctttattagtcttgctagtggtctatcaattttgttgatcctctcaaaaacccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattctgaatctttcctgctttctcttgtgggcatttagtgctataaatttccctctacacactgctatgaatgcatcccagagattctggtatgttgtgtctttgttctcgttggtttcaaagaacatctttatttctgccttcatttcgttatgtacccagtagtcattcaggagcaggttgttcagtttccatgtagttgagtggttttgagtgacattcttaatcctgcgttctagtttgattgcactgtggtctgagagatagtttgttataatttctgttcttttacatttgctgaggagagctttacttccaagtatgtggtcaattttggaataggtgtgatgtggtgctgagaagaatgtatattctgttgatttggggtggagagttctgtagatgtctaataggtctgcttgttgcagagctgagttcaagtcctggatatccttgttaaccttctgtcttgttgatctgtctaatgttgacagtggggtattaaagtctcccattattaatgtgtgggagtctaagtctctttgtaggtcactcaggacttgctttatgaatctgggtgctcctgtattgggtgcatatatatttaggatagttagctcttcttgttgaattgatcccttgaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggtgattttgcttgttagttgatgcagtttcttcctagtctcgatggtctttacattttggcatgattttgcagtggctggaaccggttgttcctttccatgtttagcacttccttcagtagctcttttagggcaggcctggtggtgacaaaatctctcagcatttgcttttctgtaaagtattttatttctccttcacttatgaagcttagtttggctggatatgaaattctgcattgaaaattcttttctttaggaatgttgaatattggcccccactctcttctggcttttagagtttctgccgagagatccgttgttagtctgatgggcttccctttgagggtaacccgacctttctctctggctgcccttaacattttttctttcatttcaactttggtgaatctgacaattatgtgtcttgcagttgctcttctcaaggagtatctttgtggcattctctgtatttcctgaatctgaatgttggcctgccttgctagattggggaagttctcctggataatatcttgcagactgttttccaacttggttccattctccccatcactttcaggtacaccaatcagacatagatttggtcttttcacatagtcccatatttcttgcaggctttgctcgtttctttttattcttttttctctaaacttcccttctcgcttcatttcattcatttcatcttccatcactgataccctttcttccagttgatcacatcagctcctgaggcttctgcattcttcacatagttctcgagccttggttttcagctccatcaactcctttaagcacttctctgtattgattattctagttatacattcttctaaatttttttcaaagttttcaacctctttgcctttggtttgaatttcctcccgtagcttggagtaatttgatcgtctgaagccttcttctctcagctcgtcaaagtcattcaacgtccagctttgttccattgctagtgaggaactgtgttcctttggaggaggagaggcgctctgctttttagagtttccagtttttctgctctgttttttccccatctttgtggttttatctacttttggtctttgatgatggtgatgtacagatgggtttttggtgtggctgtcctttctgattgttagtcttccttctaacagacaggaccctcagctgcaggtctgttggagttcctggccgtgtgaggtgtcagtctgcccctgctggggggtgcctcccagttaggctgctcaggggtcaggggtcagggagccacttgaggaggcagtctgcccgttctcagatctccagctgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtgggctccacccagttggagcttccagtctgctttgtttatgtaagcaagcctgggcaatggtgggcgcccctctcccagcctcgctgccgccttgcagtttgatctcagactgctgtgctagcaatcagcgagactccgtgggcgtaggaccctccgagtcaggtgtgggatataatctcctgatgcacccttttttaagcccattggaaaagcgcagtattcgggtgggagtgacccgattttccaggtgccgtttgtcacccctttctttgactaggaaagggaactccctgaccccttgcacttcccaagtgaggcaatgcctccccttgcttcggctcgcgcacggtgcactgcacccactgacctgtgcccagtgtctggcactccctagtgagatgaaaccagtgcctcagatggaaatgcagaaatcacctttcttctgcgtcgctcacgctgggagctgtagaccggagctgttcctattcggccatcttggctcctccctcatgttattctattaaagataggaaacacattgaatagtagtcaggtttcctgtcatatcatgtttttcattagcccatcaatgaaaccatcttccttacctttctagattgttacaccattttgtcaagtgacagctagtgtacccttcagttctttctgttttctttgcctaaaatgttcttctcctagatcttttaatagcagtgccatttttatcattcatttctcatctcaaatgccatcgtttcagaaagggattccctgaccattctgtttaaaatagtccacttatgccccttcatcatcatcccccattattctctatcatatcaccttgtttatttccttcagggaaatgattatattctgtaattttcttgtttgcttttttccgtctttcctcacttagacgtaagccccatgaggtcatgaaccttttctatcttgttcataggtaaatccctagttcccaacacagtgctgtccacgcataaagatggtaaatatttgttaaatggataaagaccctcacaccacatttagggttttttttatggtaaagacattcttggactggaagagccttgctcagagacattttgcacttccccaccacctcatatcaggtatttggatgtccaaggttgataatctttccatttttataatatgtcaaaaagtggtcctttttctgttactgctttcaatgatgacaggttttccaaaatgtaaagacaagaaactggagcattcatggaaaaaaatgttgttgtaattaaaattttgtggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacatattaacatattaaaggcagtaaaagtacctgttgtttacctttattttacccattgtttccaaacttacttgatgagaaatccttttattattattattaaactttaagttctagggtacatgtgcacaacgtacaagtttgatacataagtatacttgtgccatcttggtttgctgcacccatcaactcatcatttacgttaggtactactcctaatgctatacctcccccagccccttaccccacaacaggtgtgatgttccccactctgtgtccaagtgatcttctcgttcagtccccacctatgagtgagaagatgcggtgtttggatttctgtccttgtgatagtttgctgagaatgatggtttccagcttcatccatgtccctgcaaaggatttgaactcatccattttttatggctgcatagtatttgatggtgtatatgtgccacattttcttaatccagtctatcattgatggacatttgtgttggttccaagtctttgctattgtgaatagtgccacaataaacatacatgtgcatgtgtctttatattggcatgatttataatcctttgggtatacacccagtaatgggattgctgagtcaaatggtaattctagttctagatccctgaggaatcgccacactgtcttccacaatggttgaactaatttgcattcccaccaacagtgtaaaagttcctgtttctccacatcctctccagcatctttttaatgattgccattctaacttgcatgagatggtatcttattgtggttttgatttgcatttctctaatgaccatgatgatgagcattttttcatgtgtctgttggctgcatagatgtcctcttttgagaagtgtctgttcatatcctttgcccactttttgatgcagctttttttttcttgtaaatttgtttgagttctttgtagattctggatattagccctttgtcagatgggtagacggcaaaaattttctcccattctgtaggttacctgttcactctgatggtagtttcttttgctgtgcagaagctctttagtttaattagatcccagttgtcaattttggcttttgttttcattacttttggtgtttcagtcatggagtccttgccaatgcctgtgtcctgaatgatattgcctaggttttcttctaggatttttatggttttaggtctaacatttaagtctttaatcaatctcgagttaatttttgtataaggtgtaaggaagggatccagtttcagctttctacatatggctagccagttttcccagcaccatttattaaatagggaatcctttccccatttcttgtatttgtcaaattgtcaaagatcagatggttgtagatgtgtggtattatttctgagggctctgttctgttccattggtctatatctctgtcttggtaccagtaccatgctgttttggttactgtagccttgtagtatagtttgaagtcaggtagcatgatgcctccagctttgttctttttgcttaggattgtcttggcaatgcaggctcttttttggttccatatgaaatttaaagtagttttttttccaattctgtgaagaaagtcattggtagctcaatggggatggcattgaatctataaattacttggggaagtatggccattttcacaatattgattcttcctatccgtgagcatggaatattcttccatttgtctgtgtcctcttttatttccttgagcagtggtttgtagttctccttgaagaggtccttcacatcccttgtaagttggattcctaggtattttattctcttggaagcaattgtgaatgggaattcattcatgatttggctctctgtttgtctgttattggtgtataggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcatttcctaattgaataccctttatttatttctcctgcctgattgccctggccagaacttccaacactatgttgaataggagtggtgagagagggcatccctgtcttgtgccagttttcaaagggaatgcttccagtttttgcccattcagtatgatactggctgtgggtttgtcataaatagctctaattattttgagatatgttccatcaatacctaatttattgagagtttttagcatgaagcgctgttgaattttgtcaaaggccttttctgcatctgttgagataatcatgtggtttttttgttgttgttggttctgtgtggattacgtttattgatttgcgtatgttgaaccagccttgcatcccagggatgaagctgacttgatcgtggtggataagctttttgctgtgctgctggattcggtttgccattatattattgaggagttttgcatcaatgttcatcagggatattggtctaaaattctcttttttttttttgctgtgtctctgccaggctttgatatcaggatgatgttggcctcataaaatgatttagggaggattccctctttttctactgattggagtcatttcagaaggaatggtaccagctcctctttgtacctctggtagaattcggctgtgattccgtctggtcctggaatgtttttggttggtaggctattaattattgcctcaatttcagagcctgttattggtctattcagagattcaacttctttctggtttagtcttgggaaggttatctgtcctggaattcatccatttctttctttatatatatatactttaagttctagggtacatgtgcacaacgtgcaggtttgttacatacgtatacaggtgccatgttagtgtgctgcacccattaactcgtcatttacattaggtatatctcctaatgctatcccacccccctccccctaccccacgacaggcaccagtgtgtgatgttccccaccctgtgtccaagtgttctcattattcaattcccacctatgagtgagaacatacgatgtttggttttctgtccttgtgatagtttgctgagaatgatggtttccagcttcatccatgtccctacaaaggacatgaactcatccaactatgtgttatatgtggtcaattttagaataagtgacactgttgatttggggtggagagttctgtagatgtctattaggtccgcttgttgcagagctgagttcaagtcctggatatccttgttaaccttctgtcttgttgatctgtctaatattgacagtggggtgttaaagtctcccattattaatgtgtgggagtccaagtctctttttaggtctctcagtacttgctttatgaatctggatgctcctgtattgggtgcatatatatttaggatagttagctcttcttgttgaattgatcccttgaccattatgtaatggccttctttgtctcttttgatctttgttggtttaaagtctgttttattagagactgggattgcaacccctgctttttttttttttttttgctttccatttgcttggtagatcttcctccatccctttattttgagcctatgtgtgtctctgcacatgagatgggtctgctgaacatagcccacggatgggtcttgactctttatccaatttgccagtctgtgtcttttaactggggcatttagcccatgtacatttaaggttaatattgttatgtgtgaatttgatcctgtcattatgatgttagctggttattttcctcattaattgatgcagtttcttcctagcattgatggtctttacaatttggcatgtttttgcagtggctggtaccagttgttcctttccatgtttagtgtttccttcaggagctcttgtaaggcaggcctggtggtgacaaaatctcttagcatttacttctctgtaaaggatttaatttctccttcacttatgaagcttagtttggctggatatgaaattctgggttgaaaattcttttctttaagaatgttaaatatcggaccccactctcttctgatttgtagggtttctgccgagagatcagctgttagtctgatggacttcctttgtgggtaactcgacctttctctctggctgcccttaacactttttccttcatttcaaccttggtgaatctgacaattatgtgccttggggttgctcttctcgaggagtatctttctgttgttctctgtatttcctgaatttgaatgttggcctgccttggtaggttggggaagttctcctggataatatcctgcagagtgttttccaacttggttcccttctcccatcactttcaggtacaccagtcaaatgtagatttggtctttttccatagtcccatgtttcttggagtgtttgttcatttctttttactcttttttctctaaccttgttttctcactttatttcattaatttgatcttcaatcactgataccctttcttccacttgatcaaatcagctattgaagcttgtgcatgtgtcacgtagttctcgtggcatggttttcagctccatcaggtcatttaaggtcttctctacactgtttattctagttagccgtttgtctaatcttttttcaaggttttttgcttccttgggatgggttcaaacatcctcttttagcttggagaaatttgttattacccaccttctgaagcctacttctgtcaacttgtcagtcattctccatccagctttgttccgctgctgttgaggagctgcgagcctttggaggagaagaggcactctgatttttagaattttcagcttttctgctctggtttctccccatctttttggttttatctacctttggtctttgatgttggtgacctacagatggggttttggtgtagatgacctttttgttgatgttgatgctattcctttctgtttggtagttttccttctaacagttaggtcctcagctgcaggtctgttggagtttgctggaggtccactccagaccctgtgtgcctgggtatcaccagtggaggctgcagaacagcaaatattgcagaacagcaaatattgctgcctgatcattcctctggaagcttcatcccagacgggcagccacctctatgaggtgtctatcagcacctactgggagatgtctcccagttaggctatacagaggtcagggacccacttgaggaggcagtctgtccattctcagagctcaaacgtcgtgctgagagaaccactgctctcttcagagctgtcagacagggacatttaagtctgcagaagttgtctgctgccttttgtttagctatgccctgcccccagaggtagagtctagaggcagtaggcctggttgagctgtggtgggcaccgcccagttcaagcttccagaccactttgtttacctactcaagcctcagcaatggcagacgcccctcccccagccaggctgccacctcacagttggatctcagactgctgcgctaccagtgagcaaggctttgtgggtgtgggacccaccgagccaggcattggagagaatcttcttgtctgccagttgctaagaccttgagaaaagcacagtatttgggcgggagtgtcccgtttttccaggtagtctgtcacagcttcccgtggctaggaaagggaaatccctcaactctttgcacttcccagttgaggcgatgccatgccctgcttcagctcaccctccatgggctgcacccactgtccatccagtctcaatgagttgaaccaggtacctcagctggaaatgcagaaatcacccatcttctgcttcgctcactctgggagctgcagaccagagctgttcctatttggccatcttggaatgcccccaagaaatccttttatgataggctaactcttagtgtattatgagacactagtgttttggagagcacagtttggaaaattctgttttagaatgctcttcaaaatctagctgaataagctattctgttttttaaattctttaatttttaaaaaatttttttgtttctttttcatttttgtgggtatatggtagccatatatatttattgggtgcatgagatattttgatacaggcataccatgcataataatcacatcggggtaaaacctggcatatcttcaggaagtttgataatgtgtctggtgtacttcagtagcaaactacaaaaataaagtctagaaaagtataaaggtgactacacagttaaacccacaatcagagttgtggcttagtgcaattctcccttctttatctctacagtcagtccatggtgctgcctcacaaccactgtgccactgccacgacacctatcttctggcttttattttggattcttttcttttaattgttccatgagatgatgactttcattgtattaaagaccagctgaattacctgtcactgcttaagagactcataaaccagtgttaaatgaaggctcataaaaacaatttaaaaatgaagttgtaacagttttctataattgttgcatatgatttttttgttaagatcatgtttatattcttcaagacacatatgaataaatctctgtttctactcactctgtaacatgctatagagagttgtctatgtgacaagtagctcaattgaaagtcaatgcctacagttaaaagtgtcttcctttgcgaatagtcatggagatcgtcaccaggaaatgcacatcttttaaagcaaaaggatcatccaaaggaattggtggcatatgaggaattgattgtcctctttaccataccctgttgaaatgtgctgtagcaggacccagagctgcatgaattccagatattgttcttcaaataagttctcagggagacctggggactcaagaactgatcccaatatgatcttaccattccatctttagggtgacctttccattttacagcttgacaatggtgatacatttcagacattataaagatgttggattcctttggggatcctctttgaaatcactgtttcttttctctgccacgatgtctcagcattgtaaagaggatctgtcacttttggcagccacaatctccccatgctgaacgtgagtctactttatggtaaagaacaggctgtccctttcagtaagcacatagcctctgagtggaactctgtttcatctactgtagtagaggatcctgccttgcactttgagtggttagacactcctcagattaggcattaggcttagttgcctttgaaagagcatattgcctttgcaatcaactacaaatgatctttacattagctaatgccatgtgataaaatgtgcatgtaggatttcaagaaataaacatctgggctgggcgtggtggctcacgcctgtaatcccagcactttgggaggctgaggcgggtggatcacgaggtcaagagatcaagaccatcctggccaacatggtgaaaccccatctctactaaatatacaaaaaattagccgggcgtggtggcaggcgcctgtagtcccagctactcaggaagctgaggcaggacaatggcatgaacccaggaggcggtgcttgcagtgagccaagatcgcgccactgcactccagcctgggtgacagagcgagactccgtctcaaaaaaaataaataaaaaacaaataaacatctggaattcatgcaggtctgggtcctgctacagcacatttcaacagcgttatggtaaagtggacaatcaattccttataaaccaccactttctttggttgatccaaaggaatatatctcttttatttgccctcaagactgcctatctctcatgtttgttccttaggtgattattcctttcaaactgactttcagattatcagaactctcatttgttttaagtttttcccaatccaaatttgttcatcttcaaaatggcattttgttagtctaattttgtgatgatatccacacaaagaaataaatgcaaatatgtagatgtttgaaaacccctcctgtccatataggcagatatagaaaatgtgtatttatgaaccgaactaatcagcattttaaatgagatgtatcccagcctatattttaggtcagaccatcccaattttgttgaattgttgaatttccatttagctgttttcaacagtatagtaacaaacaggaagaaagttacttttgtttatagagattaggtccaaatggcttcaactcaccaggccactcttcagacatgctcatttccctttgcttctattcaccatctattctcccttcttagaaaaatgagtttctttatctccttcatctttttaacctacacccacagttgaacttttccaaaatctataacttgggcttggaacttcctaccctatatccccagcctcttcccttcagtttatccaggaatcttttgaaatcctacatgaacattttgtcacatggcttagctaactaattgagagaaagatggtacaatctttgctttactcagtctaaaagtattgtcacaccataatatgcacttactcctctgccttgtcacaagagtaatatgttatttccttttgaaaacattctgttcaatagtcagttgtctacaggctctttatgaccatccatgtatgatcccctttactttttagagactaagtcaaactccctctgttcagtattccacaaatgtgtgctactaatgaaaacctgtgtgtgattgagggtaaggttggggagaggaagccaactctggcatcgaaaagatgtgatcagccagatggtgaagtagttgaagaatggcattatcagctagggctggggagcaacatgtgatcaaattggtcaagacctcaaaacgatttcagagttataacaggctagttctgtacactgatgtttcccaaactctgctgcagtatattaacaagtgttatgaaaaaagaagggggatgtgattacatttaacctgatgtgtttacttattgctctcttgcctaaaacttttcagtagttactctctgcagttcaaataatttccaacctcttttccatcaactgataaggtttgcctgcctctagactctcatctggtgctatgctcctgtgaattcaactgcactccagccacactggcctttttttttcttttcctcaaactcaccaagcttttttctaattcaggctttgcacatgctcttccttctgcctggaaaattcaagcttattcatggccagcgagagacagcactcctctttcaggttatggctcacacactacctcctaaagatgcccccaaacccattgttttctctattcttttccttcatagaaatatcatgtttaattattttttcttacttcttgtctattagtcttcccccactggagtgaaagcaaggttcttgcttattttgtttacttttgtgtctccagaatacagaacagtgcctggcatatggcatgagcccaatatatatttgttgaatgaatgaatgaaatgttgttgaaaagaatacaggaactaactcaaatgtccaacaacaagaaaatgatcatatgtattatttgattaaattcaatatatttttagttataaataacaggaatattatgcaaaacaaatatttttgttaaggggaaaatatagaataaaattgtcttactccattcaacctgctataacaaaattccatgtactagataatttgtaaagaacataaatttattttctcatagttttggaggctgggaagtctaagatcaagctccagcaggttcagttgtctggcgagggtttctctctgcttccaaaatggtgccttgttgctgcattctctggcaggcagaaacattatatcctcacatgtcagaaggcaggtcaagagagccaaacactgtgtgaagccttttttctacatgccttaatcccattcacaaaggaagagccttcatggcctaattacttcttaaaggtcccactcttaatactatcacattggccattaagtttcaacatctgaaattcagaggggacacattcaaaccataacaacaatatcttctgtatgctatggtgaaatatgtatacatatggacaataataaaagtaattcagtatgtgtatatgcgctcagctgtttgttccatgaattttaacatgtttgtattatcttcataataaaaataaataatgtatctaaaattctaggtgagcaaaagaaatatcaatgcattagccttgttactatggtcaatagtagaggagaacagcaagaggaatttcaaaattcctattacagtgccaagattagtgctccaaattttttcttgagggacatggagaacttggagagatttaggagagtttggatacagaattattagagaaatactaaggaaattcattttcttttcttttttgtgactgggtctcactttattacccaggctcaagtagttctcccacttcagcctcccaaattcctggactacaggcacataccatcatgcccagctatttctttctttcttttttcttttttaagcagaggcaagatctcactatgttgtccaggctggtctcgaactcctgagctcaagcaatcctctcacctcaacctcccaaagtgctgggattacaggaatgagccaccatgcccaggcaatatagtttcttcttcaggcagaataattctactttataatctccattgagagctgaataaatagtaagggacctaagttacagtaaattatagaattacagaaataaacttttcaagatgagtgtcttaaaagcaaggaatttgtgacaaaaggagtgtgtgggatctcctacataggagaactcttagtaacagggaatttagatgattgtcttttagtcttgacaaggctaaatgtagtcctacctaaagctaaagaaaagtataaaattttccacagggttatttcagtcttgtcattctgcttcttaactttgggaagacagaaaaatatttctgctatctactatatcaggggtcccccccgtcggaccatcgaccaatctgtggcctgttaggaaccaggctgcacatcaggaggtgagcaatgggcggatgagtaagggaagcttcatgtgtatttacagctgctccccatcacttgcattatcacctaagttccgccttctatcagatcagcagtggcattagattctcataggagcgcaaaccctattgtaaatcacacatacgagggatctaggttgcgtgctccttatgagaatctaatgtctggtgatctgtcactgtctcccatcacccccatatgggactgtctagttgcaggaaaacaagttctgggctcccactgattctacattatggtgagttgtataatgagttcattatatattacaaaataataataatagaaataaagtgcacaataaatgtaatgcatttgaatcatcctgaaaccatctccccaccccagtccatggaaaaattgtcttccacaaaaccagtccctggtgccaaaaatattggggaccactgtagtatacagactaaatccattttgtttaatagcttgtttactaagcatcttgagcaaggctagagattgtaagatgagagatgcaaaaatacatatgatatggcttggatctgtgtccccacccaaatctcatgttgaattgtaatccccaatgttggaggtggcgcctggtggcaggtgatttgttcatggggatggatccttcatgaatggttcagcagcatccccttggtcctgtacttgtgatagagtcctaacaagatctggttgtgtaaaagtgtgtagcacctccccgactctctctctcttgcccctgctctggccacgtgaaacatccctgctccacctttgccttctgctatgattataaatttcctgaggcttccccagaagccaagcagatgccagcttcatgcttcctgtacaagctgcagaaccatgagccaacgaaacctcttttctttataaattacccagtctcaggtatttctttatagcaatgcaagaactgactgatcatatagtaaagaaagtgccttcaaggagcttatgggttagtaagttatacttgataaaaataaatgtgcaaacgaatataatttctagaaaaataaggtgcagcaatccttcaagactccaaatttgtaactttactctttatagactttaacagttgtcttttttattttgtttttaaatttatttttactacatttaattgtatatttgaggtttataacattatgttataggatacatacagataatgaaatagttactatagggaagcagatgaacatatctgtcatctcattgttacttgttatgtgtgacaagagcagctaaaatatttaacaaaaattcctaatacggtcacatcagtatggtactgacataaatgaagagttgtctttattctcttctatctgaccatttccctctttagtcatactcaccatacctttcatttcattatacagagtatttctaagtcagtgcagtacagaggaaagaacactagatttggaattaagagatcagttttttttttccattctgcctttcctctgcattagctgggtaactcagttgctttatctataaaatgcagatggtaagacttgccctacttacttcatataaagacaggtactttgtaaaatataaaaagccatatatatgggatggaattataaagacttcattaaatagccgggtgcggtgctcacgcctgtaatcccagcactttgggaggccgaggcaggtggatcacgaggtcaggagatcgagaccatcctggctaacacggtgaaaccccgtctctattaaaaatacaaaaaattagccgagcgtggtggcgggggcctgtagttccagctactcgggaggcggaggcaggagaatggcgtgcacccaggaggcagagcttgcagtgagccgagatcgcgccactgcactccagcctgggcgacagagcaagactctgtctcaaaaaaaaaaaaaaaaaagacttcattaaataaagcacagtataaatgggacaactcccttgaagaagaaaaaagggggtgggagaagtaaaatataatgagaaagaaatgtagactacagcgaatttttaatctagccttttatggttcttaggcatcaagacctctggcccaattttgacccagttgagatgagaaatttgaagagaggatgagaaaaactcaaatcatctcatagcctttgaaagacaggctctgaaaaaacatattgattggtatcactattttttgacttctgaataatccaaatagacttttaattagcccatttagaagttgtgggaaataaggaagttttcctaaggctgctgtagtgttgatcttctagtagagatcaagctgtttgaatttttgatgaagagttatgcccccaagcatgatgggttttctctgccttggcagaactacccaatactcttagatgatgtgtgtctatcccttaaacttcagctttgagaagcattggaaaaaatgtgtcagcccaccaaattgtcacaagcctcctggtcctagtagaacaaattctgcaatgtggggccccatccctcaacagttttaggttggatctctgcaaactttggccatcacttgcatatgttttctctctgcagacatttgtttagaacactccacatctgcttttgtctccaaagtcccacaagcataatttattcaatcctatataaaaatggcatgaaatgagtatgacgaaacctgctgtaatgatgaccaatgagttctttcccaccaccacctgatataattggcatcagctacagcccagttccactcattttttcccaggagtgacctcagcgtaagtacatttctcctcttcaggcttaaatttgattcttgtggaatgtgtagttaaagtcttgatgagttgagaagaaggaaatgagggaaaggaagataagtaattgtcaccagttggtaacctcgtaaacttggcttttcatgggactcataaaatagcgtgcagagtgtattcaactatagttattcccttagaaactccagacatattcaagcatgttcatatattagggtagctctacatagttgaaggagaaaaaacattttcagtttacatctttaatttgaaacagattttgcttatatggtagtttaattgtggataacctttcacatctagttttgttacagttggttttagtgatggtctttataacacagagatctatctgattcttagatacatttttcatatatttggctaattgggaaatcagtgaaattggtctctattcatttgtggattttgtggatagttattcttctctttgacatacttttgtctcccagtgactgattatagcttcagccttacctgtaaaggctttatctgtcagatacttggcatcctaatgaggaaggacaattagcaactttacatagcacttctgtgtttctttcgccagggttaataggtcagcctttggccttgctcaaatctattcgctcaagaagttatgaaactcttttttgggtttagagtggtagggccctcaagaatctctgatttttgatattaacacccttgtcgttttctcacccagaatgaatagggcattgtggacatgatggaatgtgaattccaaggctaggtcataaaaatacattgagtcttccaccttgctctttcttggatatttgtactgagggaagccagctgtcatatcctaagggcactcaagcagcctgtggagagctctagaattgagacctcctaccaatagccagcaaatagctgaggctttctgccacaaccatgtgagtgaaccatcttagaagaggatcctccagccccagttaagtcttcagatgactgcagcgccagctaacatttggattacaaccttatgagatacccaaggccaaaactacatagctaaactgctcctgaatttctgactccagcaactgtgtgagataataaatgcttgttgttgttttaggacactaatttttgaggtcattgtttaagcaacaataaataactaatataggaatcaacgtttgtgaaattcaaacatggtctggtttactagtggccaaactcaaggacgaaattttcaaattaagtttttaaataaacagtcatccttaaaaatagaaggctaaagagaaaaataattcatgaaagttgcactttttcttcgtgtcgttttttgtttgtttttggtttgttgttgttgttgttttttgagacagaggcttgctctgtcgcccaggctggaatgcagtggcaccatctcggctcactgcaacctccacctcctgggctcaagtgattctcccacttcagcctcccgagcagctgggattacaggtgcctgccaccatgcctggctaatttttgtatttttattagagacagggtttcaccatgttggccaggctgatcttgaactcctgacctcaggtgatccgcccacctcggcctcccagagtgctgagattacaggtgtgagccaccgtgcccggcctgtttgttttattaacttcgtcagtcaccaaaaagggggggaaaagttgaaaagggactgcctgtgttagaacacaaccaaaatgtcccaagccttgacttgttagtattgagaagaaggaatagaggtttgttcccatgttaccaaataaacaactcccaggaatatttggaggaacctggcacctgggcagtcagcagaaacatgtgtttacttgactccttcggtgtactaaaagggaatcttggtctcttcagattccaggtggagagtgctttggagccccaactgatacaggcccccagttttgttgctgtctccctcatacctaataaaccttactgcaaaattgaaggaagagagcagaaaattttgagtatgtgagaatggcagagactaaagtagcttattcagatgctgatgtaaaggattgggtactttttgaccagttgattgataaaagaatcaccttgtggaatacgggttgtgtatggagttttgaagaatgaaggggaacccagggttgtgctaagagttgttggtgcttattgagaagtcccagtcagaaataatgcaagtacctttctagcaccaatgagaaggttcttaagggtatctgctcctcagtggcctatactagacatatcagacatatggacaagtgtgattcccaaaatattggggatactgataaatgaatgcctacttttttaaatgtagtaaattagcatacagtaaaatgtacttgttgtggggggagttttactgttcagtgagtttccatatacatgcatatttatttaccaccgtaatcaggatacagagcagttccatcaccaaaaaactccttcatactacctatatgtggtcataccctcctctctccttactactaccaaccactgatttgttttgtcttttcaagaatattatataaatatatgtaagtgcatatatacagcatgtaaccgctgagactggtttctgtcactcagcataatgcctttgagattcatctaacttgctgcatgcatcaatagctcacttggtttttgctaagttgtattccgttgtttgaatgtaccacaggtttttttttaatccattcacacattgaagcaagtttcagctttttttttccagttttggtgattataaatagaactactaaatacattgatgtacaggtttttatgtgaacataagttttcatttctctgggataaatacataggagtgggtcatatgataatgtgataatacctagtactgggtcatatgataagtctatttttatgttttactttaaatgaaactgtcaaactgttttccagaatggttgtgccattttgcattcccactggtaatgtatgagagtgccacttgttctacttctttactagcacttggtattgttactacttttcttttaattttagccattctaataggtgtgtagtgttatagtgattttaattttacattttcctaatggctaattgtatggatcatcttttcatatgttcaactgtctactttttattttgcaaagtaaggacattcaaaacttaaatataaaaggacattataacatcaaaaagttaataaatgtagcttcatgaaaagtttaccacattgtcttaattattttaccttaggccacttgaaatttggttgtgaataggcattggtctatagtactgacaagcccctaatgtctaggaccagttcttttggcattggcattattgtaagaattcagggatcagcatagtagttcctcttgctgaagggtcttactagataaatcttcattggctctatgccatttacagggtcacatgcaaactttctggcatgatagttgggatactttatagtttttcatcccactaccattttttctttatctcctactattctctctactactttgtttctagccacctcacttactttactgtcccccatacaatccccagtttcatccttcatctggaatgcccatcaagcctattcagatcctacttattcttcaagctgttattcagtgtttcaccaagtatattctgaggaaatcctgcattggaatattctagaattatgaaatgtgcagattcctgggccctgctctggacttactgaattagactttctggggatgggccccaggaactgaaattccaacaagtgtccagtatgtgatccttagtcacaactgaatatgagaacccctgaatctagctgaagtcctatctttgtgaagccgtcatatgtgagtcctactccatagtgatttcacctttcttttaaggattgtcaaactttcttcctatttaaatttgtcagcagcactcattttgacatttcatctattatttaaatgttaaagtgtgatttagtttataagccactgaagaataggaattcatatcccgtttaacatgtagcataatatagtttaatataatgcacacaaagtctatacacacacacacacacacacacacacacacacacacacacacacatacatattatttccatcctttttggtagtggagttctgagattcaaggagaaccacaattgtttctaatcattttttcaaaggcatagttctgtgaacaatgatgatgtaaagctttgggaatcttgcctttgatttgagatattttctactcccagtgctaaactgaattaagcctttgaaaatcccattgacactttaaaaaatcttaaatatttgttatatgaaggggtggtagtgtctcattgcttttgtagtgtgttgactagccaagcacgcttgtctttgaaacataccatgttgattccacttgctcctcagtgctttattcatgccatctaagtttcgtatactaacctctctttctgctgaaatttttcccattattcaagtcccacagcaattctcaactcctctataaaacttactgttacaacttgagcctacaaggatttctctcttctgtgaactcctagtacttcctgcctataattctcatttggcacttaacgtatacattgtctggtaacatactgttgttttcttgctccactcttattatttaactttccatgggtgaatgtcatgctttgcaagctagccacgattcctcgatgttcaggaacttttttaaaaatatgtttttctagtgtagaaaaaaaatgaagaatttaagtagttgtagcaatacattgacctttatagaaacaactgttggtggtggaagctgacagaggatgttgcaatgctagtttcttaaagaggcaaccagtgtgaaaatcagtattatacaaaggcagatgtattgggatatgacttatgtacaactttaaataatgtttttttactccatgcttgtaaatatattcataatttgcagtacataatgattaatgatgtgagggtgtgattaaggccatatctatacctgacctgcatactgatccatggcaggcatgaccaaactgctcgcttgatctttataatcaatattaattgttgtggctgaatccatcatgtgatgagtcccattggttgttaagaaatccttaaaaacagatggccagtaccttggtctgttgattccacgcatgtagttgtggttttatatactgaaggacagatgacagcatacaacacctctgtggcttattagtagagttggtctgattcagaggatacctggactttttgcccttttacaaggtctgaagaagtaggaatggtttgagcctctgtcattttctcaaattccctttggttcagaggctacttatccagtgcagaaagatagaaggcacccttagcttttacctttctccaactcatttaatccaatcaggaacctagttctgtgcagcctacccttataacatctcttgagtccatgctgtatttctatccttactactgctgccttatttcaaggtttcttatatcactaagattaactgtttcactacctacagtctcatctgcttccaatatatattccatagtcattgggagggatcatgttattcttccttaaaatgtttccatggcttctattgcttaaatgataaaatgtagtctttaggatggcatccaaagccctccattgtctggccactgcctgactttccacagtcatctctggagaatcccatttgtattctctagccacattgaattagttcctggatgtatcatgctgttttatgccttcatgcttttgcacatactacatgttatgcttggaatgctcttttccagtttatcattctaccccataaaggctctgaacaagtactattttacactcttctattatttgtgcctccactgcttcctatacacatttccatcttagcccctgtgaaatcttatttgtttatatgtctgactaccccaaatagactataaacttcttttggaggggggttataaaagtaaaatttatttagaatgacaaagaaattataacaaattataaatcttcaaacatttacaccaaaacgtcacaaaatctagatcaagggtttgtgtgtgtgtgtgtgtgtgtgtgtgtgtgcacgtgtgtgtataacttttgtaaattttcctgaagcaaataggatatcttttgaatgttggcactctcagatgaaactaagtagagatcaggtcttctcaccctgctcaatttcttccttcatggcttctcactgtaactattacttttattctcttttgtgcttatgcatttaaaattttctgcattttatcaatatgttctaactaaatttaaccagtttctattgaaagagcaatgaaataaaagccaatttaatcacacatattataacttatgccaacaatgctttggatgtattcacctatgtgtgcatctgttctttttcagctctcatttatttgttgattagatttaaaaccactgtgccttgtgcacattggcatcacatcccacttggaagagaaaaatcctcagtagatatacaatgatgtaaatcttgtgactctatcaaatgaacaggtttcagtaacatctttccacctgtttggctagttccaagaacttttatttctcccttttatacaactggaaatgaaggcagagaatgataaatgaactgggttcctatagtccaacacagtgattctctctttggtccagtgtcatccctatcatctggaaacttagaaatgcagattcccagccacatcccatatctactgaatcaaaaactctaaaatgtagagggagaggcagcaatatgtaatttaacatgaagtcaagatgattctgatgcatgctaagtttgaaaagcacgggaacttaaagatcctagtatgctattgattgccctgttttctccttgttctgaaattaatgtataaggcatgttatatcctacagaaaaatgccttagtggtattctatcattatgcaaaactgaaaatcaagggagatctttgtgtgccctccttcacggagggtaggaagtttggcattatagcagattatagatctacagagacggagtttccctcttgttgcccaggatggagtgcaatggcacaatctcagctcaccgcaacctccgcttcctgggttcaagtgattctcctgccttagcttcccaagtaactgggattacaggcatgtgccaccatgcctggctaatattgtatttttagtagagacggggtttctccatgttggtcaggctggtctcgaactccctacctcaggtgatccacccacctcagcctcccaaagtgatttttaaaatacccttttaagtacatggttgaactggcccaaaattaaataacatctctaaaagctacaaataatcagacatcacaaatacagagcagtaaactaggggtagtgagctactatttggcatttgtctgagtatatctgctgatctccgttggcctttagttcggttttaatgggccactcaagtttgggagcagaagataaaactagagacctgagaaaggtgggaggtcagattggagagccccgaattaagccaagatttccaaagggtcacaggcatattggatgaactaggaaaagaaatccttgcagatggagcaatggaaatacatgcctgtctcagtcttggtgctgactggagtgagaaaaaaaaattctccactaagatttcctaatcacaagcccacactcaaaaaaaggttgagactagaattcccactgctggtgtggcctgaaaaacccacagagatatctggaactttaaacatctcccacattggtactgctttccaagcacctcatagatataatgcaaatcatattttgaagaattcatttaaacacaagcttcaaataattcctacagataaagttcccatgaacatgaattcacaataaaaaatcacacaatttatgaagaagtaagccattataagtgactaagcagaaataaatagcaaactacaggagcagatctacaaatacaacagaaattatcagataacagactataaaataattggcataatatagttaaataaaagaaggccctgaggtatgatgaaggtataggagactatcaaatgtgacaggcaaatttgaaaaagaaccaagtagaatatctgtaaatgaaaaatataatcattaaaattagaaattccatagattaaatagattagacacagatgaagagagaatgaggaattgaaataaattatacagaatgtaacacagagaacaaagaggtggaaaacaggctaggttaagaaacatggaggatagaatgagaaaggtctaccatgtgtttaattggagttccagagagataaaatgggggaaaggcaatatttaaagagagaatgactgaaattttcccaaaattgatgaacagtacccaatttaggattttcaataagttctaagcaagttaaattaaaaatcgtaatccaggcttagacatattgtggtgaaagtatgaaacacccaaatcagagaaaagctcaacattagccaggcaaaaaagattatacttagaagaaagacaactaaactcaataaaatgacagctaactgacagcaacagtggaagccagaagaaattgtgatagtatcttccatagtcaatgacagtagtcagcaaatgttttctgtaaaaagcgcaataataattattttaggctttgcgggccatgtacagtctttgttgcatactcctctgtttgttttttgtttgtttgtttgtttttggtttctttcacaacactttcaaatataaaaacaattcttagctcaagggtcacaccgaaacacactgcaggccagatttggcctataggtcatagtttgcttaccctaatctgtgagataataactgttgttttgttcattttattttatggtcaggggtacatgtgcaggtttgttaggcaaacttgtgtcatgggggtttattatatagattatttcgtcactcaggtattaagcctattactcaacagttatttttcctaatcctttcccttctcccaccctccaccctccaccttccgacaggccccactgtggtttgttttgttttgttttgtttgagatggaatctcactctgtcgcccaggctggagtgcagtgataccatctcagctcaatgcagcctctgcctcctgggttcaagcgattctccagtctcagcctcccgtgtagctgcgattataggcacctgccaccatgcccagctaatttttgtatttttagtagagacagggtttcaccatgttggccaggctggtcttgaactcctcacctcaggttatctgcccatctcagcctcccaaagtgctgggattacaggcatgagtctcagtgtgtattgttcccctctatgtgtccatgtgttgtcatcatttagctcccaattatagataagaacatgtgatattttggttttctgttcctgcattagtttgcttaggataaaggcttccagctccatccattttcctgcaaaggacatgatctcattctttttatggctgcaagtatttcacggtgtatagataccacattttctttatccagtctatcactgatggacatttagattgggtccatgtctttgctgttgtgaatagtgctgcaatgaacatacgcatgcatgtgtctttataatagaacaatttatattcctttgggtatatacccagtaatgggattgctgggtcaaatgtatttctgtctttaggtctttgaggaatcaccacactgtcttccacagtggttgaactaatttacactcccaccaacagtgtataagcattcctttttctccacaaccttgccagcatgttatttttttacttttttactttttcatgatagctattctgattgatgtgagatgacatgtcattgtggttttgatttgcatttccctaatgatcagtgatgctgagctttttttttcacatgatttttggcagtgtatatgtcttttgaaaagtgtctgtttatatcctttgcccactctttcatgaagttggttgttttcttataattttaagttccttatagatgcagatattacacctttgtcagatgcatggtttgcaaaaaatttctcccattccgtaggttgcctgttcactcggttgatagtttcctttgctctgcagaagctcttaagtttaattagatcacatttgtcagtttttgcttttgttccagttgcttttggaaagcaaagatttcttcgttgtgaaatctttgcctgtttctatgtcttgaatgatatcacctaagttttcttccagggtttgtgtagttttgggttttacatttaagtctttaatccatctttaattaatttttctatatagtataaggaaggagtccagtttcaatcttctgcatatggctagacagtattcccagcaccatttattgaataaggagtcttttttccattgcttatttttgtcaggtttgtggaagaccagatggttgtaggtgtgcggccttatttctgggttctctattctgttccattggtctacatgtctgtacttataccagtaccatgctattttgcttgctgtagccccatagtatagtttgaagtcagatagcatgttacctgcagctttgttctttttgcttaagattgtcttgtatattcggggtcttttctggttctatctgaattttaaaatagtttttttctagttctgtgaagaatctcaatggtagtttatttttttgctcagcattttatttattttttatttatttcaataggtttttggggaacaggtgatgtttggttacgtggataagtcctttagtgatgatttctgagattttggtgcacccatcacccaagcagtatacactgcaccttatttgtagtcttttatccctcacccctctcccacacttcccctcaagtccccaaagtccattgtatcattcatgtctttgcatcctcatagcttagctctcacttataagtgagaatatacaatgtttgattttccactcctgagttacttcacttagaatgatggtctccaactccatccaggttgctgcaaatgccattatttcattcctttttatggctgagtagtattccatggtgtgtgtgtgtgtgtgtgtgtgtgtgtgtgtgtgtgtgtgttgcaaattctgctgctataaacatgcatgtgtaaggttttttttttcatataatgtcttattttcctcgaggtagatacccagtagtgggattgctgtatcaaatggtagatctacttttagttctttaaggaaactctatactcttttccataaaggttatactaattgacattcccaccagcactgtaacagtgttcccttttcaccacatccacaccaacatctgttattttttgattttttaattatggccattcttgtagtagtgaggtggtatcacctggtggttttgatttgcatttccctgataatttgtgatgttgagcatttttcatatgtttgttggctgtttgtatatcttcttttgataactgtctattcatgtccttagcttactttttgatgcgattatttttttttttggagggggctgatttgtttgagttctttgtagcttctggacgttagtcctttgtcagatgcatagtttgcaaagattttctcccactctgtgggttgtctgtttactctgctaactgttcctcttgccatccaaaagctctttagtttaattaagtcccacctatttgactttgtttttgttgcatttgcttttgggtttttggtcatgcagtctttgcctaagccaatgtctagaagggcttttctgatgttatcttctagaatttttacagtttcaggtcttaggtttaagtccttgatccatcttgagttgatttttttgtacgaggtgggagacgaggatccaatttcattttccaacatgtggcttgccaattatcccagaaccggttgttgaacagggtgtcatttccctactctatgtttttctttgctttgtcgaagatcagttggctgtaagtatttggctttatttctgagttctctattctgttccattaatctatgtgcctatttttataccagcaccatgctgttttggtgactgtagccttatagtttgaagtcccgtattgtgaggcctccagatgtgttctttttgcttagtgttgctttggctatgcaggctcttttttggttccatatgaattttagaattgttttttctagttctgtgaaaaacgatgaaggtattgttatgggaattgcattgaatttgtagattgcttttggcagtatggtcattttcacaatattgattctgtctatcagtgagcattggatgtgtttccattttggctatgcgggctcttttttggttctatatgaattttaggattgttttttctcgttctgtgaaaaatgatgaaggtattgttatgggaattgcattgaatttgtagattgcttttggcagtatggtcattttcacaatattgattatatctatcgatgagcattggatgtgtttccattttgtctatgtgggctcttttttggttccatatgaattttaggattgtttgttttatctagttctgtgaaaaacgatgaaggtcttgttatgggaattgcattgaatttgtagattgcttttggcagtatggtcattttcacaatattgattctatctatcgatgagcactggatgtgtttctatttgtttgtgtactatgatttctttcagcagtgctttgtagttctccttgtagagatctttcacctccttggttagctgtattcctaggtattttattcttttgtggcaattgtgaatgagattgcattcctgatttggctctcagctttcctgttgttggtgtataggaatgctactgatttttgtacattgattctgtaccctgggactttgcctaagttgtgtatcagcttaagaagcttttgggccaagactatagggttttctaaatactggatcacgtcatctgcacacagggatagtttgactttctctttaccaatttggatgccctttatttcattatcttgcctgattgctctggccaggacttctaatactatgatgaataggagtcaagagagggcatccttgtcttgtgagtgttttcaagggggatgcttccagcttttgcccattaagtatattggctgtgggtttgccatagatggctcttattatttttaggtatgcttcttcaatacctagtttattgagtttttttaaaaaccatgaagaggtgttgaattttattgaaaaccttttctgtatctattgtgataatcatgtgggttttgtctttagttctatttatgtgatgaatcacattcattgatctgtgtctgttgaaccaaccttgcatcccagggataaagtatatttgatcgtggtggataagctttttgatgtgctgctggagttcgtttgctggtattttgttgaggatttctgcatcaatgttcatcaaggatattggcctaaagttttctttttttgatgttatctctgtcaggttttggtattcagatgatgctagccttgtagaatgagttagggaggaatccctcctcatcatttttttgaaatagtttcagtaggcatgaaaccaactcttctttgtacatctcgtagaaaccagctatgaatctctctggtcctgggctttttttggttggcaggctatttattactgcctcacttatggagcttgttattggtctgttcagggattcaatttcttcctggttcaatcttgggaaggtatgtgtgtccaagaatttaaccatttcttctagattttctagtttatgtgcatagaggtgttcataatattctttgatgattgtttgtatttctgtggggtcagtggtaatattccctttgtcatttctttttgtgtttatttgaatcttctctcatttcttctttattagtttagctagtggtatgtctatttaattaattttttcaaagaaacagctcctagattcattaatcttttaaatggttttccatgtctctatctccttcagttcacctctgattttggttatttcttgttttctgctagctttggggtttgtttgttcttgattctcaagtctttaagttgtgatgttaggttaacttgagatctttctaactttttgatgtgggcatttagtgctataaatttacctcttaacagtgccttagctgtgtcccagagattctggtatgttgtatctttgttctcagtaatttcaaagaacttcttgatttttgccttaatttcattatttatccaaaagtcattcaggagcaggttattcaatttccatgtaattgtatggtcttgagccttagttttgatttctaacttgtttgtactgtggtccaggatattcttttgttatgatttcggttctttggcatttgctgaggagtgctttgcttacaattatgcaatcgattttagagtatgtgccatgtagtgatgagaagaatgcatattctgtagtttttgggtggagagttctgtggatatctatcaggttcatatgatccattgctgagttcatgtcttgagtatctttgttaattttgtctcaatgatctgtctaatattgtcagtgaggtgttaaagtctctcactattattgtgtgggtgtctaagtctctttgaaggtctctaagaacttgctttatgaatctgggtacttctgtgttgggtgcatatatatttaggatagttagatcttctttttcaatagaaccctttaccattatataatgcccttccttgtattttttttttttatctttgctggtttaaagtctgttttatcagaaatcagggttgcaacaactgttgttttctgttttctctttgcttggtagatttttctccatccctttattttgagccaatgtatgccattgcatgtgagatggatctcttgaagacagcataccaatggatcttggctctttatccagcttgccactctgtgtcttttaattggggtgtttggctcatttacatttaagattagtattgatatgtatggatttgatcctgtcatcatgatgttagctggttatttttcagacttgattatgtggttgcttcataatgtcactggtctgtgtacttcagtgtgtttttgtagtgattggtaatggtctttcctttccatatttagtgctcccttcaggagctcttgtaaggcaggtttggtggtaacaaattccctcagcatttgcttgtctgaaaatgaccttatttctcctttgcttatgaagcttagtttggcgggatatgaaattatgggttggaatttattttctttaagagtgttgaatattggcttccaatctcttctggcttatagggtttctgagatgttcactggtaatctgatgatgggcttccctgtgtaggtgacctgaccttctctctagctgcatttaacattttttctttcatttcaaccttggaaaatctgatgattatgtgtcttggggtcgaccttctcaaagagtatcttcttggggttctctgcatttcctttatttgaatattggcttctctagttaggttggggaaattctcatggatgatatcctgaaatatgttttccaagttggttctattctccccatctctttcagggacaccaatgagttgtgtcttccctctgtccactctcagcaccttcactctgaagatctgttaaaagcacacgagtcgtctcagtccctcagtgggagctgtttcacctggcgtcatctagtcagccatcttcaataataactgttaaatggacatttatatccactgaaaccactaagtgaaataaagatgtgtttaggcaaa
